US010669337B2

(12) United States Patent
Irving et al.

(10) Patent No.: US 10,669,337 B2
(45) Date of Patent: Jun. 2, 2020

(54) BISPECIFIC ANTI-CD3 ANTIBODIES, BISPECIFIC ACTIVATABLE ANTI-CD3 ANTIBODIES, AND METHODS OF USING THE SAME

(71) Applicant: CytomX Therapeutics, Inc., South San Francisco, CA (US)

(72) Inventors: Bryan Allen Irving, Woodside, CA (US); Sherry Lynn La Porte, San Francisco, CA (US); Jason Gary Sagert, San Mateo, CA (US); Daniel Robert Hostetter, Palo Alto, CA (US); Olivia Jennifer Razo, Newark, CA (US); Clayton William White, San Francisco, CA (US); Jennifer Hope Richardson, Fremont, CA (US)

(73) Assignee: CytomX Therapeutics, Inc., South San Francisco, CA (US)

( * ) Notice: Subject to any disclaimer, the term of this patent is extended or adjusted under 35 U.S.C. 154(b) by 600 days.

(21) Appl. No.: 14/808,711

(22) Filed: Jul. 24, 2015

(65) Prior Publication Data
US 2016/0194399 A1    Jul. 7, 2016

Related U.S. Application Data

(60) Provisional application No. 62/029,325, filed on Jul. 25, 2014.

(51) Int. Cl.
*C07K 16/28* (2006.01)
*A61K 39/395* (2006.01)
*C07K 16/30* (2006.01)
*A61K 47/68* (2017.01)

(52) U.S. Cl.
CPC ........ *C07K 16/2809* (2013.01); *A61K 39/395* (2013.01); *A61K 47/6803* (2017.08); *A61K 47/6831* (2017.08); *A61K 47/6845* (2017.08); *A61K 47/6849* (2017.08); *A61K 47/6851* (2017.08); *A61K 47/6879* (2017.08); *A61K 47/6889* (2017.08); *C07K 16/2863* (2013.01); *C07K 16/30* (2013.01); *C07K 2317/31* (2013.01); *C07K 2317/56* (2013.01); *C07K 2317/565* (2013.01); *C07K 2317/622* (2013.01); *C07K 2317/64* (2013.01); *C07K 2317/72* (2013.01); *C07K 2317/73* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 3,773,919 A | 11/1973 | Bostwell et al. | |
| 4,361,549 A | 11/1982 | Kung et al. | |
| 4,485,045 A | 11/1984 | Regen | |
| 4,522,811 A | 6/1985 | Eppstein et al. | |
| 4,544,545 A | 10/1985 | Ryan et al. | |
| 5,013,556 A | 5/1991 | Woodle et al. | |
| 5,030,719 A | 7/1991 | Umemoto et al. | |
| 5,151,510 A | 9/1992 | Stec et al. | |
| 5,733,743 A | 3/1998 | Johnson et al. | |
| 5,968,509 A | 10/1999 | Gorman et al. | |
| 7,381,803 B1 | 6/2008 | Weiner et al. | |
| 7,465,790 B2 | 12/2008 | Waldmann et al. | |
| 7,951,918 B2 * | 5/2011 | Glaser .................. | A61K 39/395 530/387.3 |
| 7,994,289 B2 | 8/2011 | Waldmann et al. | |
| 8,513,390 B2 | 8/2013 | Stagliano et al. | |
| 8,518,404 B2 | 8/2013 | Daugherty et al. | |
| 8,529,898 B2 | 9/2013 | Daugherty et al. | |
| 8,541,203 B2 | 9/2013 | Daugherty et al. | |
| 8,563,269 B2 | 10/2013 | Stagliano et al. | |
| 8,809,504 B2 | 8/2014 | Lauermann | |
| 8,846,042 B2 | 9/2014 | Zhou | |
| 9,120,853 B2 | 9/2015 | Lowman et al. | |
| 9,169,321 B2 | 10/2015 | Daugherty et al. | |
| 9,181,349 B2 | 11/2015 | Baurin et al. | |
| 9,249,217 B2 | 2/2016 | Bigner et al. | |
| 9,453,078 B2 | 9/2016 | Stagliano et al. | |
| 9,545,442 B2 | 1/2017 | Lowman et al. | |
| 9,562,073 B2 | 2/2017 | Moore et al. | |
| 9,889,211 B2 | 2/2018 | Lowman et al. | |
| 10,138,272 B2 | 11/2018 | Moore et al. | |
| 10,179,817 B2 | 1/2019 | Sagert et al. | |

(Continued)

FOREIGN PATENT DOCUMENTS

| | | |
|---|---|---|
| EP | 1 523 503 | 4/2009 |
| EP | 1 324 771 | 6/2011 |

(Continued)

OTHER PUBLICATIONS

Watanbe et al., Oncology Reports 26: 949-955, 2011 (Year: 2011).*
Robert W. Bahr, Deputy Commissioner for Patent Examination Policy Memorandum of Feb. 22, 2018, 2 pages (Year: 2018).*
Lutterbuese et al. (PNAS 107, 12605 (2010)) (Year: 2010).*
Chatenoud, Current Opinion in Immunology 2005, 17:632-637 (Year: 2005).*
Sebastian et al. (Cancer Immunol Immunother (2007) 56:1637-1644) (Year: 2007).*
Guilmeau et al. (Oncogene (2010) 29, 992-1002 (Year: 2010).*
Letter of F. Hoffmann-La Roche Ag, filed to the European Patent Register on Mar. 22, 2013 in connection with their opposition to the EP2155788 patent, 39 pages (Year: 2013).*
"D17" filed in conjunction with the letter of F. Hoffmann-La Roche Ag on Mar. 22, 2013, pp. 1-4 . (Year: 2013).*

(Continued)

*Primary Examiner* — Zachary S Skelding
(74) *Attorney, Agent, or Firm* — Cooley LLP; Ivor R. Elrifi; Cynthia A. Kozakiewicz

(57) ABSTRACT

The invention relates generally to antibodies, activatable antibodies, multispecific antibodies, and multispecific activatable antibodies that specifically bind to at least CD3, as well as to methods of making and using these antibodies, activatable antibodies, multispecific antibodies, and/or multispecific activatable antibodies in a variety of therapeutic, diagnostic and prophylactic indications.

16 Claims, 25 Drawing Sheets

Specification includes a Sequence Listing.

(56) References Cited

U.S. PATENT DOCUMENTS

| | | |
|---|---|---|
| 2004/0109855 A1 | 6/2004 | Waldmann et al. |
| 2006/0269547 A1 | 11/2006 | Bolt et al. |
| 2009/0304719 A1 | 12/2009 | Daugherty et al. |
| 2010/0189651 A1 | 6/2010 | Stagliano et al. |
| 2010/0189727 A1 | 7/2010 | Rodeck et al. |
| 2012/0149061 A1 | 6/2012 | Stagliano et al. |
| 2012/0207756 A1 | 8/2012 | Stagliano et al. |
| 2012/0237512 A1 | 9/2012 | Daugherty et al. |
| 2012/0237977 A1 | 9/2012 | Daugherty et al. |
| 2012/0244154 A1 | 9/2012 | Daugherty et al. |
| 2013/0129730 A1* | 5/2013 | Kufer ............... C07K 16/2809 424/135.1 |
| 2013/0150558 A1 | 6/2013 | Williams et al. |
| 2013/0309230 A1 | 11/2013 | Stagliano et al. |
| 2013/0315906 A1 | 11/2013 | Lowman et al. |
| 2014/0010810 A1 | 1/2014 | West et al. |
| 2014/0024810 A1 | 1/2014 | Stagliano et al. |
| 2014/0045195 A1 | 2/2014 | Daugherty et al. |
| 2014/0154253 A1* | 6/2014 | Ng .................... C07K 16/2803 424/136.1 |
| 2014/0255313 A1 | 9/2014 | Vasiljeva et al. |
| 2014/0302064 A1 | 10/2014 | Moore |
| 2014/0363430 A1 | 12/2014 | West et al. |
| 2015/0005477 A1 | 1/2015 | Lowman et al. |
| 2015/0079088 A1 | 3/2015 | Lowman et al. |
| 2015/0118254 A1 | 4/2015 | Lowman et al. |
| 2016/0122425 A1 | 5/2016 | Daugherty et al. |
| 2016/0193332 A1 | 7/2016 | Lowman et al. |
| 2016/0194399 A1 | 7/2016 | Irving et al. |
| 2016/0200826 A1 | 7/2016 | West et al. |
| 2016/0220537 A1 | 8/2016 | Garner et al. |
| 2016/0228546 A1 | 8/2016 | Stagliano et al. |
| 2017/0081397 A1 | 3/2017 | Stagliano et al. |
| 2019/0135943 A1 | 5/2019 | Boustany et al. |

FOREIGN PATENT DOCUMENTS

| | | | |
|---|---|---|---|
| EP | | 2155788 B1 | 6/2012 |
| EP | | 2155783 B1 | 7/2013 |
| WO | WO 1991/001752 A1 | | 2/1991 |
| WO | WO 1991/009966 A1 | | 7/1991 |
| WO | WO 1992/006193 A1 | | 4/1992 |
| WO | WO 1992/022653 A1 | | 12/1992 |
| WO | WO 1994/11026 A2 | | 5/1994 |
| WO | WO 1994/028027 A1 | | 12/1994 |
| WO | WO 1995/016037 A1 | | 6/1995 |
| WO | WO 1997/044362 A1 | | 11/1997 |
| WO | WO 2001/91798 A2 | | 12/2001 |
| WO | WO 2002/030460 A2 | | 4/2002 |
| WO | WO 2004/003019 A1 | | 1/2004 |
| WO | WO 2004/009638 A1 | | 1/2004 |
| WO | WO 2004/106380 A2 | | 12/2004 |
| WO | WO 2005/040220 A1 | | 5/2005 |
| WO | WO 2005/047461 A2 | | 5/2005 |
| WO | WO 2006/107786 A2 | | 10/2006 |
| WO | WO 2007/024705 A2 | | 3/2007 |
| WO | WO 2007/027935 A2 | | 3/2007 |
| WO | WO 2007/033230 A2 | | 3/2007 |
| WO | WO 2007/042261 A2 | | 4/2007 |
| WO | WO 2007/105027 A1 | | 9/2007 |
| WO | WO 2007/109254 A2 | | 9/2007 |
| WO | WO 2007/146968 A2 | | 12/2007 |
| WO | WO 2007/147001 A2 | | 12/2007 |
| WO | WO 2008/119565 A2 | | 10/2008 |
| WO | WO 2008/119566 A2 | | 10/2008 |
| WO | WO 2008/119567 A2 | | 10/2008 |
| WO | WO 2009/014726 A2 | | 1/2009 |
| WO | WO 2009/018386 A1 | | 2/2009 |
| WO | WO 2009/025846 A2 | | 2/2009 |
| WO | WO 2010/037836 A2 | | 4/2010 |
| WO | WO 2010/037838 A2 | | 4/2010 |
| WO | WO 2010/042904 A2 | | 4/2010 |
| WO | WO 2010/093395 A1 | | 8/2010 |
| WO | WO 2010/096838 A2 | | 8/2010 |
| WO | WO 2010/109924 A1 | | 9/2010 |
| WO | WO 2010/127284 A2 | | 11/2010 |
| WO | WO 2010/129609 A2 | | 11/2010 |
| WO | WO 2011/028811 A2 | | 3/2011 |
| WO | WO 2010/081173 A2 | | 7/2011 |
| WO | WO 2011/109789 A2 | | 9/2011 |
| WO | WO 2012/025525 A1 | | 3/2012 |
| WO | WO 2012/135345 A1 | | 10/2012 |
| WO | WO 2012/158818 A2 | | 11/2012 |
| WO | WO 2012/162067 A2 | | 11/2012 |
| WO | WO 2013/092001 A1 | | 6/2013 |
| WO | WO 2013/113615 A1 | | 8/2013 |
| WO | WO 2013/128194 A1 | | 9/2013 |
| WO | WO 2013/158856 A2 | | 10/2013 |
| WO | WO 2013/163631 A2 | | 10/2013 |
| WO | WO 2013/186613 A1 | | 12/2013 |
| WO | WO 2013/188693 A1 | | 12/2013 |
| WO | WO 2013/192546 A1 | | 12/2013 |
| WO | WO 2013/192550 A2 | | 12/2013 |
| WO | WO 2014/047231 A1 | | 3/2014 |
| WO | WO 2014/079000 A1 | | 5/2014 |
| WO | WO 2014/107599 A2 | | 7/2014 |
| WO | WO 2015/001085 A1 | | 1/2015 |
| WO | WO 2015/013671 A1 | | 1/2015 |
| WO | WO-2016071355 A1 * | | 5/2016 ......... C07K 16/2896 |
| WO | WO 2016/118629 A1 | | 7/2016 |
| WO | WO 2017/157305 A1 | | 9/2017 |
| WO | WO 2019/075405 A1 | | 4/2019 |

OTHER PUBLICATIONS

Letter of Affimed Therapeutics, filed to the European Patent Register on Apr. 29, 2014 in connection with their opposition to the EP2155783 patent, 10 pages (Year: 2014).*

"D4" filed in conjunction with the letter of Affimed on Apr. 29, 2014, pp. 1-5. (Year: 2014).*

"D05" document, pp. 1-5, which was made available in the European Patent Register associated with EP2155788 sometime prior to Apr. 29, 2014. (Year: 2014).*

Letter of Chugai Seiyaku filed Apr. 29, 2014 in connection with their opposition to the EP2155783 patent, pp. 1-19. (Year: 2014).*

Malcolm et al. (Journal of Immunological Methods 384 (2012) 33-42) (Year: 2012).*

Bluemel et al. (Cancer Immunol Immunother (2010) 59:1197-1209). (Year: 2010).*

Pace et al. (PNAS, (2013) vol. 110, No. 33, pp. 13540-13545). (Year: 2013).*

Polu et al. (Expert Opin. Biol. Ther. (2014) 14(8):1049-1053) (Year: 2014).*

Vajdos et al. (J Mol Biol. Jul. 5, 2002;320(2):415-28). (Year: 2002).*

Bedouelle et al. (FEBS J. Jan. 2006;273(1):34-46). (Year: 2006).*

Dong et al., JBC, vol. 286, No. 6, pp. 4703-4717 and supplemental pp. 1-6 (2011). (Year: 2011).*

Dufner et al (Trends Biotechnol 24(11): 523-529, 2006). (Year: 2006).*

Irving, "Probodies Empower a New Generation of Antibody Immunotherapies," presented at Keystone Symposia on Molecular and Cellular Biology, Feb. 2015.

Baeuerle, P.A. and Reinhardt, C., Bispecific T-cell engaging antibodies for cancer therapy. Cancer Res. 69, 4941-4944 (2009).

Boersma, Y.L. et al., Bispecific designed ankyrin repeat proteins (DARPins) targeting epidermal growth factor receptor inhibit A431 cell proliferation and receptor recycling. J. Biol. Chem. 286, 41273-41285 (2011).

Bostrom, J., et al., Variants of the antibody herceptin that interact with HER2 and VEGF at the antigen binding. Science 323, 1610-1614 (2009).

Chan, A.C. and Carter, P.J., Therapeutic antibodies for autoimmunity and inflammation. Nature Reviews Immunol. 10, 301-316 (2010).

Chichili GR et al. A CD3xCD123 bispecific DART for redirecting host T cells to myelogenous leukemia: Preclinical activity and safety in nonhuman primates. Sci Transl Med. May 27, 2015;7(289).

(56) References Cited

OTHER PUBLICATIONS

Cochlovius et al., Cure of Burkitt's lymphoma in severe combined immunodeficiency mice by T cells, tetravalent CD3 x CD19 tandem diabody, and CD28 costimulation. Cancer Res. 60, 4336-4341 (2000).
Deng, R. et al., Subcutaneous bioavailability of therapeutic antibodies as a function of FcRn binding affinity in mice. mAbs 4, 101-109 (2012).
Donaldson J et al. Design and development of masked therapeutic antibodies to limit off-target effects:application to anti-EGFR antibodies Cancer Biology & Therapy vol. 8 (No. 22) Nov. 1, 2009 pp. 2147-2152.
Dong et al., A stable IgG-like bispecific antibody targeting the epidermal growth factor receptor and the type I insulin-like growth factor receptor demonstrates superior anti-tumor activity. MAbs. 3(3):273-88 (2011).
Fitzgerald and Lugovsky, Rational engineering of antibody therapeutics targeting multiple oncogene pathways. MAbs. 3(3):299-309 (2011).
Grosschedl et al. Cell-type specificity of immunoglobulin gene expression is regulated by at least three DNA sequence elements. Cell 41:885 (1985).
Jackman, J., et al., Development of a two-part strategy to identify a therapeutic human bispecific antibody that inhibits IgE receptor signaling. J. Biol. Chem. 285, 20850-20859 (2010) Epub May 5, 2010.
Junttila TT, et al., Antitumor efficacy of a bispecific antibody that targets HER2 and activates T cells. Cancer Res. Oct. 1, 2014;74(19):5561-71. Epub Sep. 16, 2014.
Kroesen, B.J., et al. Bispecific antibodies for treatment of cancer in experimental animal models and man. Adv. Drug Delivery Rev. 31, 105-129 (1998).
Linke, R., Klein, A., and Seimetz, D., Catumaxomab: clinical development and future directions. mAbs 2, 129-136 (2010).
Liu, M.A., et al., Heteroantibody duplexes target cells for lysis by cytotoxic T lymphocytes. Proc. Natl. Acad. Sci. USA 82, 8648-8652 (1985).
Lund, J. et al., Multiple binding sites on the CH2 domain of IgG for mouse Fc gamma R11. Mol. Immunol. 29, 53-39 (1992).
Lutterbuese R, et al. T cell-engaging BiTE antibodies specific for EGFR potently eliminate KRAS- and BRAF-mutated colorectal cancer cells. Proc Natl Acad Sci U S A. Jul. 13, 2010;107(28):12605-10. Epub Jun. 28, 2010.
Okayama et al. A cDNA cloning vector that permits expression of cDNA inserts in mammalian cells Mol. Cell. Bio. 3:280 (1983).
Malmqvist, Biospecific interaction analysis using biosensor technology, Nature, vol. 361: 186-187 (1993).
Marvin, J.S. and Zhu, Z., Recombinant approaches to IgG-like bispecific antibodies. Acta Pharm. Sinica 26, 649-658 (2005).
Nisonoff, A. and Mandy, W.J., Quantitative estimation of the hybridization of rabbit antibodies. Nature 194, 355-359 (1962).
Olafson, T, Fc engineering: serum half-life modulation through FcRn binding. Methods Mol. Biol. 907, 537-556 (2012).
Orcutt, K.D. et al., A modular IgG-scFv bispecific antibody topology. Prot. Eng. Design Select. 23, 221-228 (2010).
Petkova, S. B. et al., Enhanced half-life of genetically engineered human IgG1 antibodies in a humanized FcRn mouse model: potential application in humorally mediated autoimmune disease. Intl. Immunol. 18, 1759-1769 (2006).
Reusch U et al Anti-CD3 x anti-epidermal growth factor receptor (EGFR) bispecific antibody redirects T-cell cytolytic activity to EGFR-positive cancers in vitro and in an animal model Clinical Cancer Research, AACR vol. 12 No. 1, Jan. 1, 2006 p. 183-190.
Riethmuller, G., Symmetry breaking: bispecific antibodies, the beginnings, and 50 years on. Cancer Immunity 12, 12-18 (2012).
Spangler, J. B. et al., Triepitopic antibody fusions inhibit cetuximab-resistant BRAF and KRAS mutant tumors via EGFR signal repression. J. Mol. Biol. 422, 532-544 (2012)).
Sun LL et al. Anti-CD20/CD3 T cell-dependent bispecific antibody for the treatment of B cell malignancies. Sci Transl Med. May 13, 2015;7(287).
Wu, C., et al., Simultaneous targeting of multiple disease mediators by a dual-variable-domain immunoglobulin. Nature Biotechnol. 25, 1290-1297 (2007).
*Amgen* vs *Sanofi and Regeneron* Case: 17-1480 Document: 176 Filed: Feb. 6, 2018, 27 pages.
Brorson et al. "Mutational Analysis of Avidity and Fine Specificity of Anti-Levan Antibodies", Journal of Immunology, vol. 163, p. 6694-6701 (1999).
Brummell et al. "Probing the combining site of an anti-carbohydrate antibody by saturation-mutagenesis: role of the heavy-chain CDR3 residues", Biochemistry, vol. 32, p. 1180-1187 (1993).
Burks et al. "In vitro scanning saturation mutagenesis of an antibody binding pocket", PNAS, vol. 94, p. 412-417 (1997).
Caron et al. "Engineered Humanized Dimeric Forms of IgG Are More Effective Antibodies", J. Exp Med., vol. 176, p. 1191-1195 (1992).
Colman "Effects of amino acid sequence changes on antibody-antigen interactions", Research in Immunology, vol. 145, p. 33-36 (1994).
Desnoyers et al., "Tumor-Specific Activation of an EGFR-Targeting Probody Enhances Therapeutic Index," Science Translational Medicine, vol. 5, Issue 207 (207ral44), 10 pages, (2013).
Epstein et al., "Biological activity of liposome-encapsulated murine interferon gamma is mediated by a cell membrane receptor", Proc. Natl. Acad. Sci. USA, vol. 82, p. 3688-3692 (1985).
Ibragimova et al. "Stability of the β-Sheet of the WW Domain: A Molecular Dynamics Simulation Study", Biophysical Journal, vol. 77, pp. 2191-2198 (1999).
Jang et al. "The structural basis for DNA binding by an anti-DNA Autoantibody", Molecular Immunology, vol. 35, p. 1207-1217 (1998).
Kiewe P. "Ertumaxomab: a trifunctional antibody for breast cancer treatment", Expert Opinion on Investigational Drugs, vol. 17, p. 1553-1558 (2008).
Kobayashi et al. "Tryptophan H33 plays an important role in pyrimidine (6-4) pyrimidine photoproduct binding by a high-affinity antibody", Protein Engineering, vol. 12, No. 10, p. 879-844 (1999).
Kumar et al. "Molecular Cloning and Expression of the Fabs of Human Autoantibodies in *Escherichia coli*", Journal of Biological Chemistry, vol. 275, p. 35129-35136 (2000).
La Rocca et al, "Zymographic detection and clinical correlations of MMP-2 and MMP-9 in breast cancer sera", British Journal of Cancer, vol. 90, p. 1414-1421 (2004).
Shopes B. "The Genetically Engineered Human IgG Mutant with Enhanced Cytolytic Activity", Journal of Immunology, vol. 148, No. 1, p. 2918-2922 (1992).
Smith-Gill et al. "Contributions of Immunoglobin Heavy and Light Chains to Antoibody Specificty for Lysozome and two Haptens", The Journal of Immunology, vol. 139, p. 4135-4144 (1987).
Song et al. "Light chain of Natural Antibody Plays a Dominant Role in Protein Antigen Binding", Biochemical and Biophysical Research Communications, vol. 268, p. 390-394 (2000).
Stevenson et al., "A chimeric antibody with dual Fc regions (bisFabFc) prepared by manipulations at the IgG hinge", Anti-Cancer Drug Design, vol. 3, p. 219-230 (1989).
Ward et al. "Binding activities of a repertoire of single immunoglobin variable domains secreted from *Escherichia coli*", Nature, vol. 341, p. 544-546 (1989).
Bagshawe, K.D. (2006) "Antibody-directed enzyme prodrug therapy (ADEPT) for cancer" *Expert Rev Anticancer Ther*, 6(10):1421-1431.
Dimasi, N. et al. (2009) "The Design and Characterization of Oligospecific Antibodies for Simultaneous Targeting of Multiple Disease Mediators" *J Mol Biol*, 393:672-692.
Conrad, M.L. et al. (2007) "TCR and CD3 Antibody Cross-Reactivity in 44 Species" *Cytometry Part A*, 71A:925-933.
Croasdale, R et al. (2012) "Development of tetravalent IgG1 dual targeting IGF-1R-EGFR antibodies with potent tumor inhibition" *Archives of Biochemistry and Biophysics*, 526(2):206-218.

(56) References Cited

OTHER PUBLICATIONS

Jäger, L. (Ed.) *Klinicheskaja immunologija i allergologija.* [*Clinical Immunology and Allergology*] vol. 2. 2nd Edition, M.: Medicina, 1990; pp. 484-485 (Russian, translated from German).

* cited by examiner

Multispecific activatable antibody arrays:

FIGURE 8A
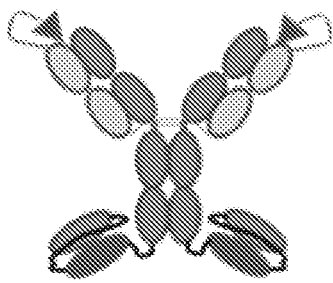
FIGURE 8B
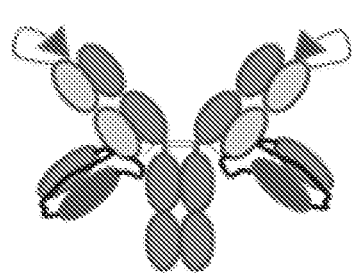
FIGURE 8C
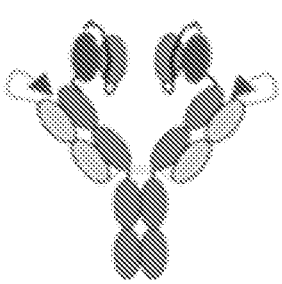
FIGURE 8D
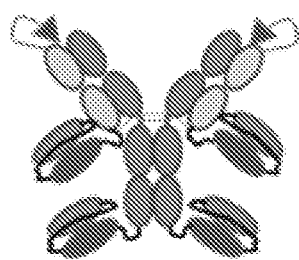
FIGURE 8E
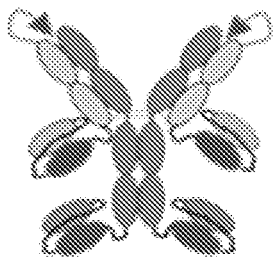
FIGURE 8F
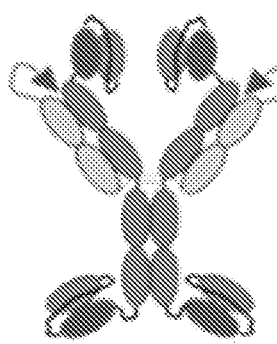
FIGURE 8G
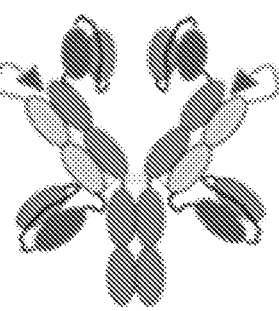
FIGURE 8H
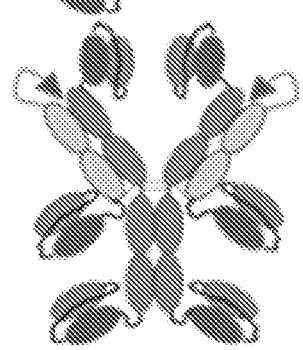
FIGURE 8I
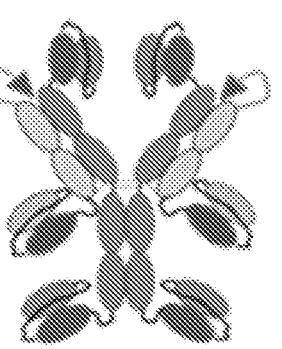
FIGURE 8J

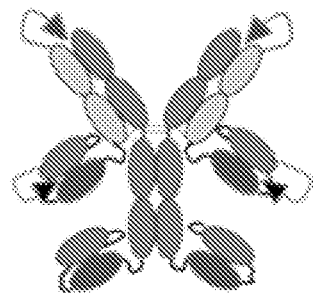
FIGURE 11A
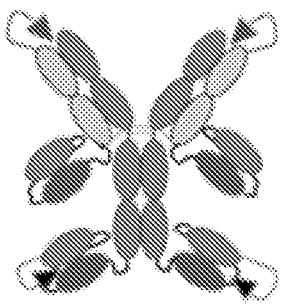
FIGURE 11B
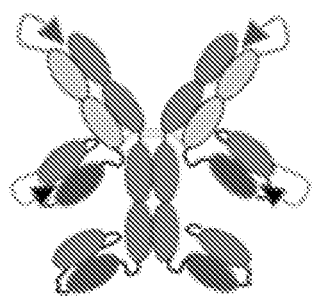
FIGURE 11C
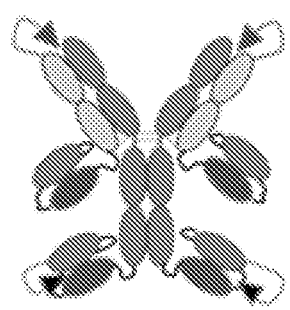
FIGURE 11D
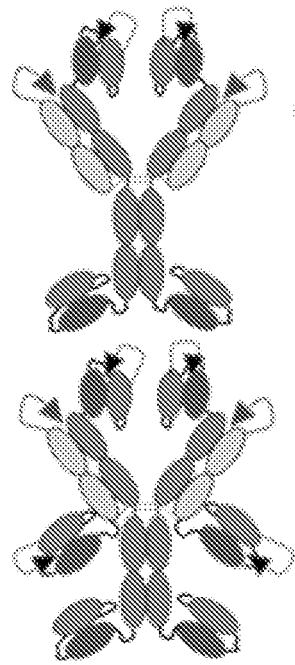
FIGURE 11E
FIGURE 11H
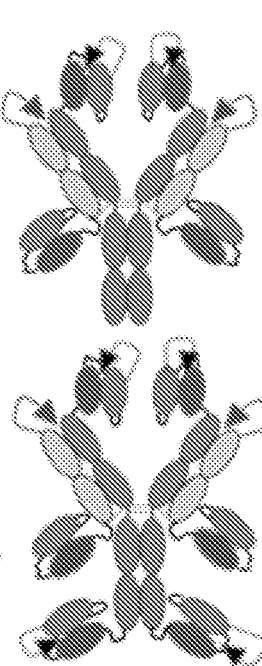
FIGURE 11F
FIGURE 11I
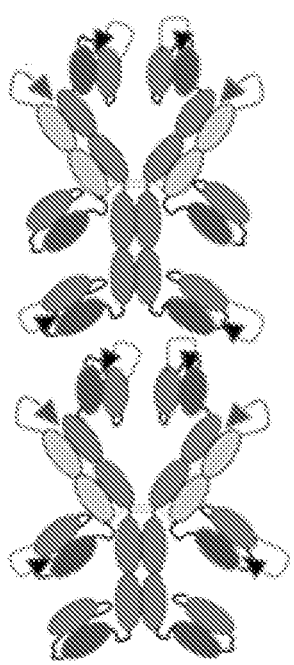
FIGURE 11G
FIGURE 11J FIGURE 12A    FIGURE 12B
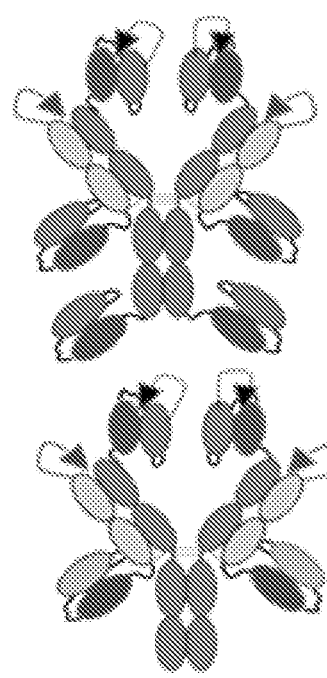 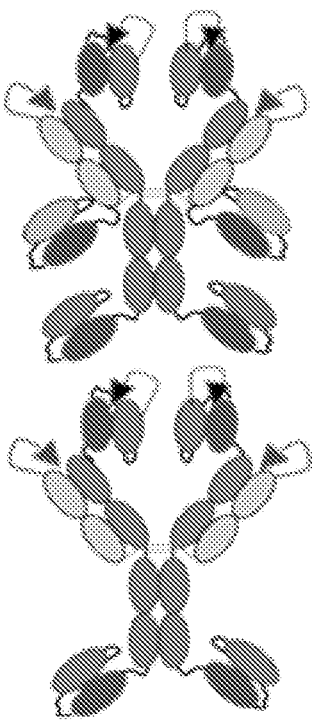
FIGURE 12C    FIGURE 12D

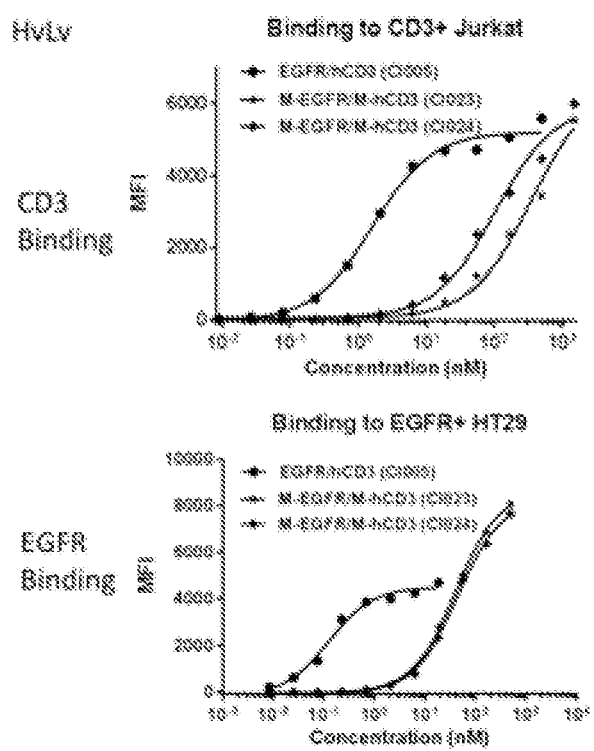
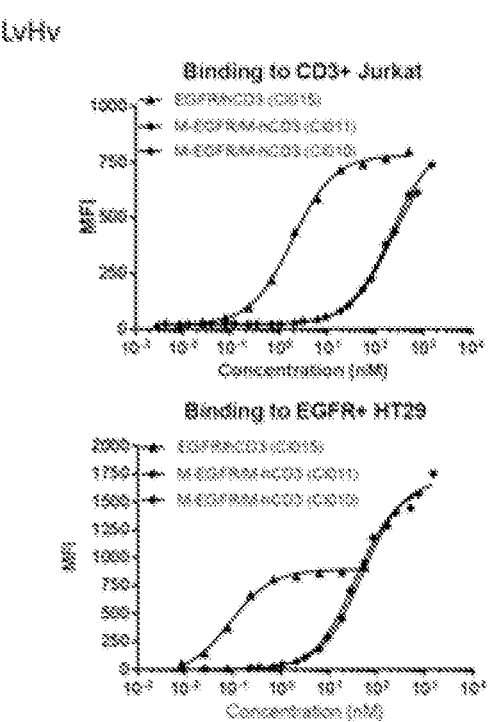
FIGURE 15A
FIGURE 15B
FIGURE 15C
FIGURE 15D

FIGURE 16A
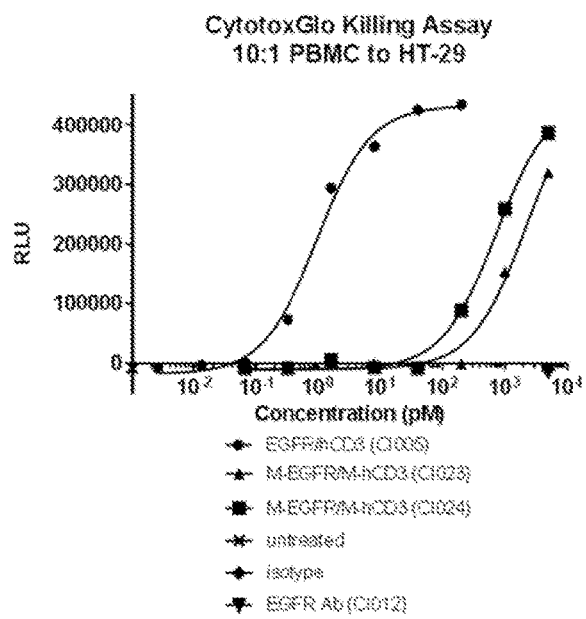
FIGURE 16B
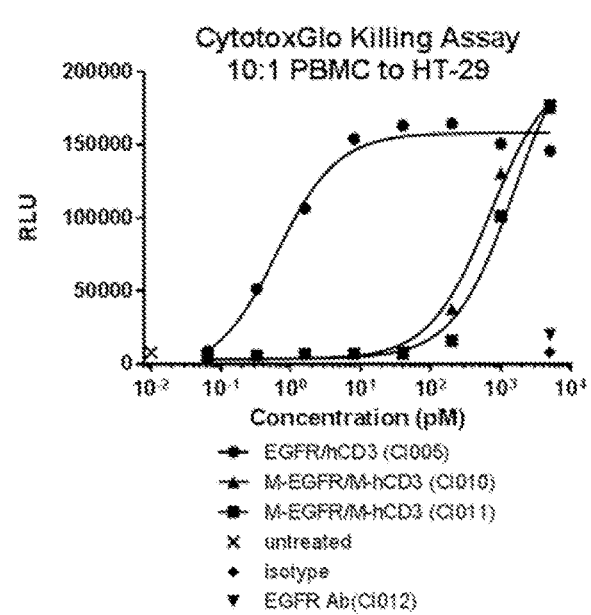
FIGURE 17A
FIGURE 17B
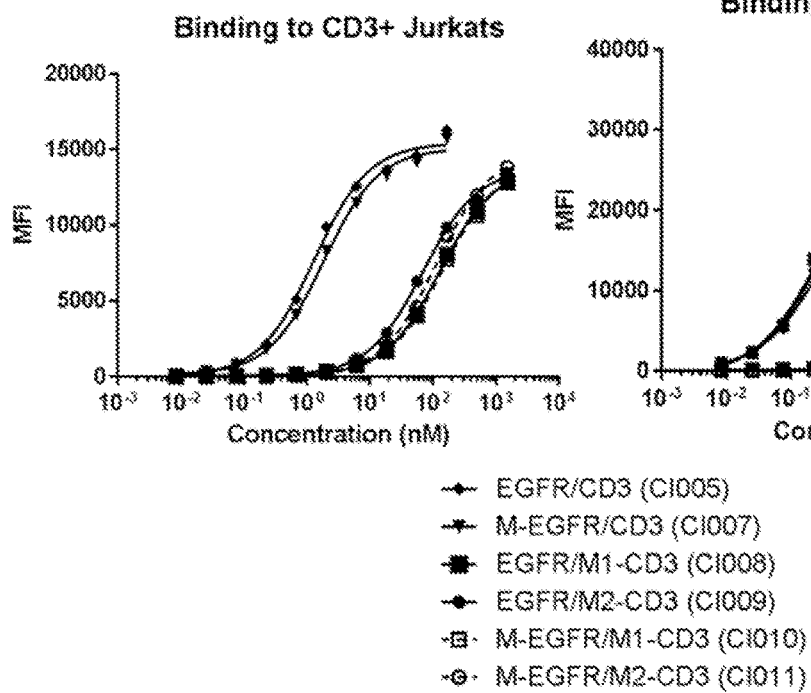
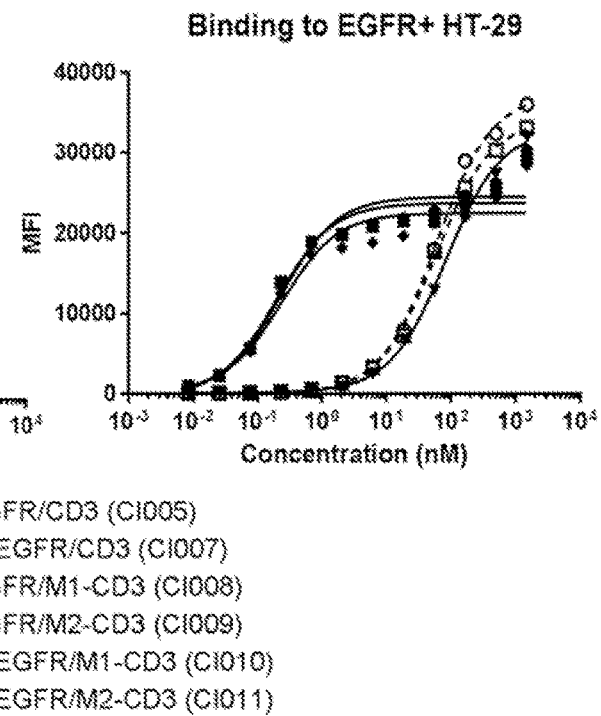

FIGURE 18A
FIGURE 18B
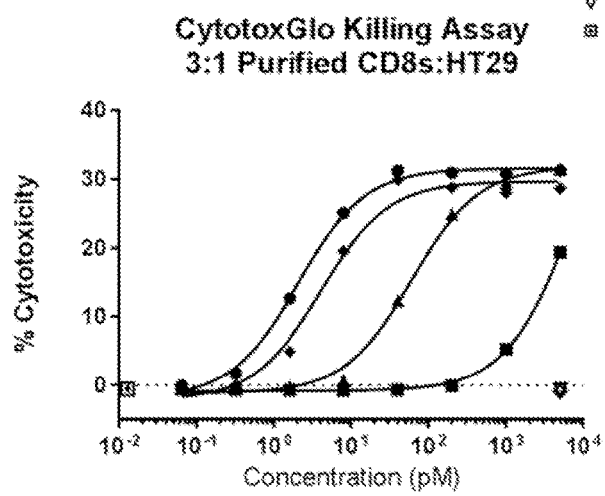
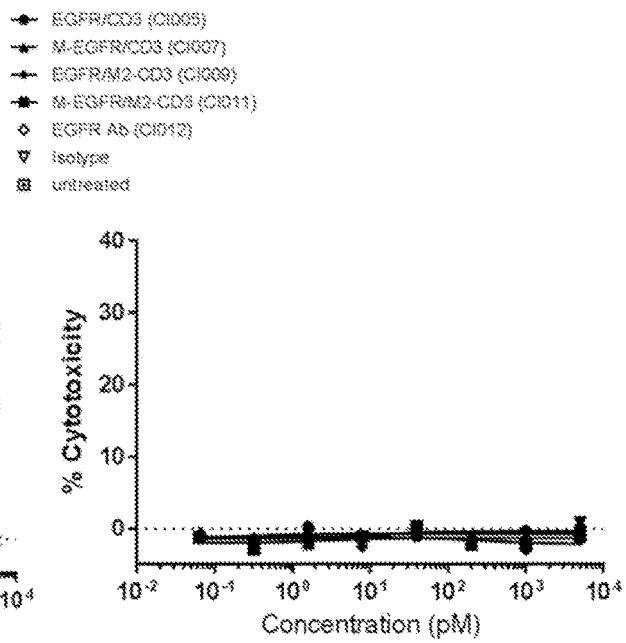
FIGURE 19
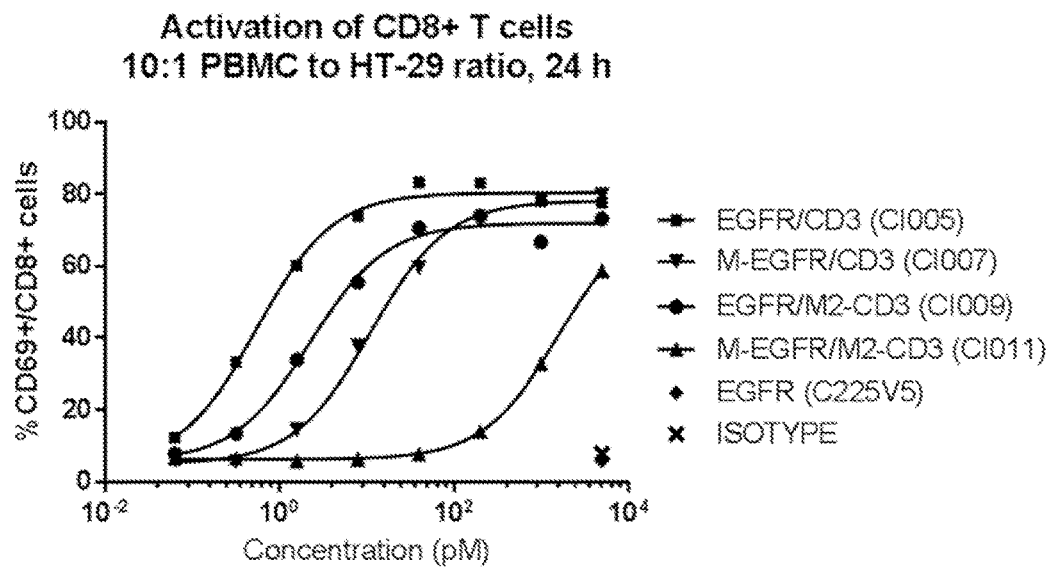

10:1 PBMC to U266 cells (24 hours)

FIGURE 21A
FIGURE 21B
FIGURE 21C
FIGURE 21D
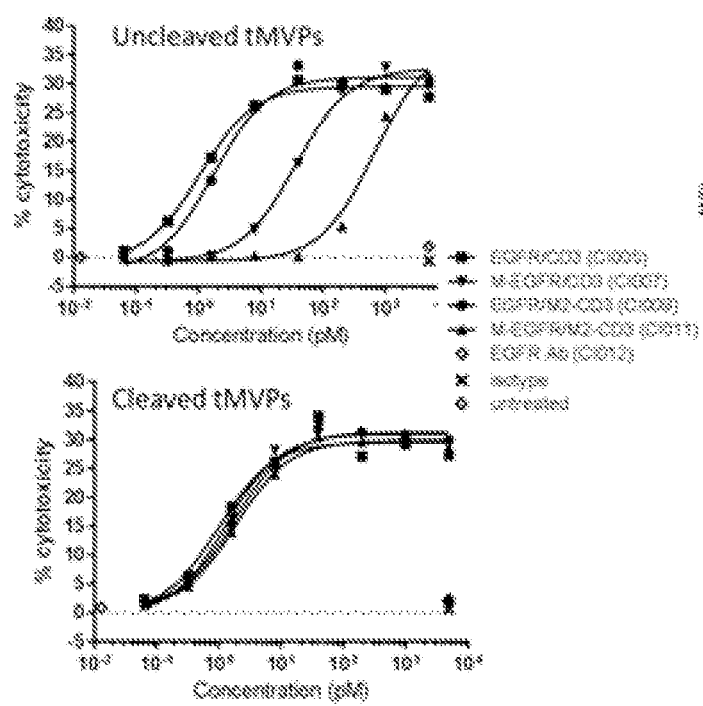
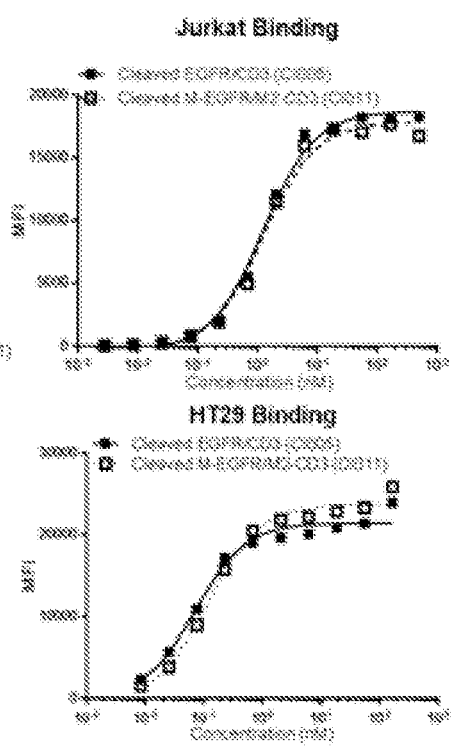
FIGURE 22
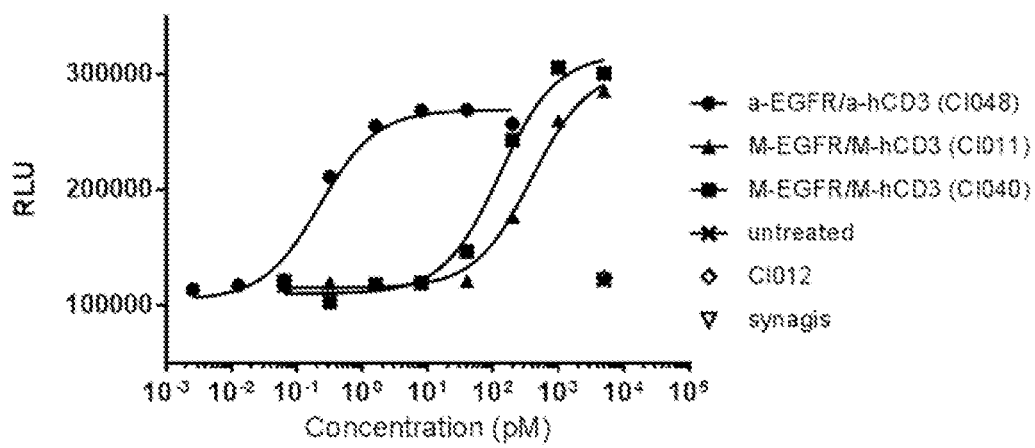

^Dosed IV on days 0 & 7 for CI005
& dosed daily days 0-7 for BiTE

^CI048 & CI011 were dosed IV on days 0 & 7
Dose 0.1 mg/kg

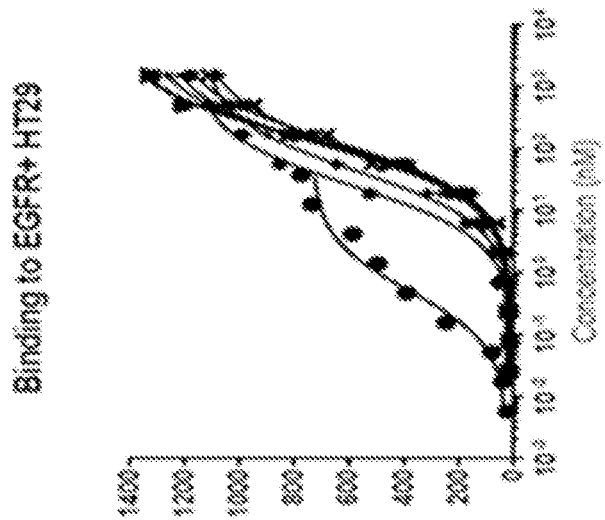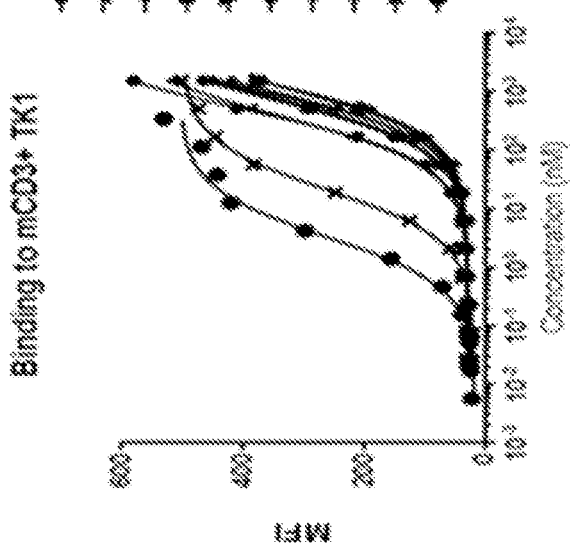

BISPECIFIC ANTI-CD3 ANTIBODIES, BISPECIFIC ACTIVATABLE ANTI-CD3 ANTIBODIES, AND METHODS OF USING THE SAME

RELATED APPLICATIONS

This application claims the benefit of U.S. Provisional Application No. 62/029,325, filed Jul. 25, 2014, the contents of which are incorporated herein by reference in their entirety.

INCORPORATION OF SEQUENCE LISTING

The contents of the text file named "CYTM_035_001US_SubSeqList_ST25", which was created on Aug. 29, 2018 and is 1.076 MB in size, are hereby incorporated by reference in their entirety.

FIELD OF THE DISCLOSURE

The invention relates generally to antibodies, activatable antibodies, multispecific antibodies, and multispecific activatable antibodies that specifically bind to at least CD3, as well as to methods of making and using these antibodies, activatable antibodies, multispecific antibodies, and/or multispecific activatable antibodies in a variety of therapeutic, diagnostic and prophylactic indications.

BACKGROUND OF THE DISCLOSURE

CD3 (Cluster of Differentiation 3) T-cell co-receptor is a multimeric protein composed of four distinct polypeptide chains, referred to as the ε, γ, δ, and ζ chains. The CD3 complex serves as the signaling module of the T cell receptor that associates non-covalently with the antigen-binding a/b chains of T cell receptor (TCR).

Because direct engagement of CD3 results in T-cell activation, it is a desirable target for a variety of therapeutic and/or diagnostic indications. Accordingly, there exists a need for antibodies and therapeutics that target the CD3/TCR pathway.

SUMMARY OF THE DISCLOSURE

The present disclosure provides antibodies and antigen-binding fragments thereof that specifically bind the epsilon chain of CD3, also known as CD3ε. The anti-CD3ε antibodies and antigen-binding fragments thereof of the disclosure activate T cells via engagement of CD3ε on the T cells. That is, such antibodies agonize, stimulate, activate, and/or augment CD3-mediated T cell activation. These antibodies and antigen-binding fragments thereof are referred to herein as "anti-CD3ε antibodies" or "anti-CD3 antibodies." The anti-CD3ε antibodies and antigen-binding fragments thereof of the disclosure include monoclonal antibodies, such as, for example, mammalian monoclonal antibodies, primate monoclonal antibodies, fully human monoclonal antibodies, as well as humanized monoclonal antibodies and chimeric antibodies, as well as antigen-binding fragments thereof. In some embodiments, the antibodies and antigen-binding fragments thereof are IgG isotype. In some embodiments, the antibodies and antigen-binding fragments thereof are IgG1 isotype. In some embodiments, the antibodies and antigen-binding fragments thereof have one of any of the isotypes disclosed herein.

In some embodiments, the anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); and a VH CDR3 sequence that includes at least the amino acid sequence HGNFGNSYVSWFAY (SEQ ID NO: 55).

In some embodiments, the anti-CD3ε antibody or antigen-binding fragment thereof includes a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the anti-CD3ε antibody or antigen-binding fragment thereof includes a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence TYAMN (SEQ ID NO: 53); a VH CDR2 sequence that includes a sequence that is at least 90%, 91%, 92%, 93%, 94%, 95%, 96%, 97%, 98%, 99% or more identical to the amino acid sequence RIRSKYNNYATYYADSVKD (SEQ ID NO: 54); and a VH CDR3 sequence that includes a sequence that is at least 90%, 91%, 92%, 93%, 94%, 95%, 96%, 97%, 98%, 99% or more identical to the amino acid sequence HGNFGNSYVSWFAY (SEQ ID NO: 55).

In some embodiments, the anti-CD3ε antibody or antigen-binding fragment thereof includes a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that includes a sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that includes a sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence TYAMN (SEQ ID NO: 53); a VH CDR2 sequence that includes a sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that includes a sequence that is at least 90%, 91%, 92%, 93%, 94%, 95%, 96%, 97%, 98%, 99% or more identical to the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that includes a sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that includes a sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the anti-CD3ε antibody or antigen-binding fragment thereof includes a VH CDR1 sequence that is at least 90%, 91%, 92%, 93%, 94%, 95%, 96%, 97%, 98%, 99% or more identical to the amino acid sequence TYAMN (SEQ ID NO: 53); a VH CDR2 sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that is at least 90%, 91%, 92%, 93%, 94%, 95%, 96%, 97%, 98%, 99% or more identical to the amino acid sequence HGNFGNSYVSWFAY (SEQ ID NO: 55), a VL CDR1 sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the anti-CD3ε antibody or antigen-binding fragment thereof includes a variable heavy chain (Hv) comprising the amino acid sequence of SEQ ID NO: 4. In some embodiments, the anti-CD3ε antibody or antigen-binding fragment thereof includes a variable light chain (Lv) comprising the amino acid sequence of SEQ ID NO: 2. In some embodiments, the anti-CD3ε antibody or antigen-binding fragment thereof includes a variable heavy chain (Hv) comprising the amino acid sequence of SEQ ID NO: 4 and a variable light chain (Lv) comprising the amino acid sequence of SEQ ID NO: 2.

In some embodiments, the anti-CD3ε antibody or antigen-binding fragment thereof includes a variable heavy chain (Hv) comprising an amino acid sequence that is at least 90%, 91%, 92%, 93%, 94%, 95%, 96%, 97%, 98%, 99% or more identical to the amino acid sequence of SEQ ID NO: 4. In some embodiments, the anti-CD3ε antibody or antigen-binding fragment thereof includes a variable light chain (Lv) comprising an amino acid sequence that is at least 90%, 91%, 92%, 93%, 94%, 95%, 96%, 97%, 98%, 99% or more identical to the amino acid sequence of SEQ ID NO: 2. In some embodiments, the anti-CD3ε antibody or antigen-binding fragment thereof includes a variable heavy chain (Hv) comprising an amino acid sequence that is at least 90%, 91%, 92%, 93%, 94%, 95%, 96%, 97%, 98%, 99% or more identical to the amino acid sequence of SEQ ID NO: 4 and a variable light chain (Lv) comprising the amino acid sequence of SEQ ID NO: 2.

In some embodiments, the anti-CD3ε antibody is an scFv antibody fragment that binds CD3ε. In some embodiments, the anti-CD3ε scFv antibody fragment includes the amino acid sequence of SEQ ID NO: 6. In some embodiments, the anti-CD3ε scFv antibody fragment includes the amino acid sequence of SEQ ID NO: 30. In some embodiments, the anti-CD3ε scFv antibody fragment includes an amino acid sequence that is at least 90%, 91%, 92%, 93%, 94%, 95%, 96%, 97%, 98%, 99% or more identical to the amino acid sequence of SEQ ID NO: 6. In some embodiments, the anti-CD3ε scFv antibody fragment includes an amino acid sequence that is at least 90%, 91%, 92%, 93%, 94%, 95%, 96%, 97%, 98%, 99% or more identical to the amino acid sequence of SEQ ID NO: 30.

In some embodiments, the anti-CD3ε antibody also includes an agent conjugated to the antibody. In some embodiments, the agent is a therapeutic agent. In some embodiments, the agent is a detectable moiety. In some embodiments, the detectable moiety is a diagnostic agent. In some embodiments, the agent is conjugated to the anti-CD3ε antibody via a linker. In some embodiments, the linker is a cleavable linker. In some embodiments, the linker is a non-cleavable linker.

In some embodiments, the anti-CD3ε antibody naturally contains one or more disulfide bonds. In some embodiments, the anti-CD3ε antibody can be engineered to include one or more disulfide bonds.

The disclosure also provides an isolated nucleic acid molecule encoding at least a portion of an anti-CD3ε antibody described herein and/or one or more nucleic acid molecules encoding an anti-CD3ε antibody described herein, such as for example, at least a first nucleic acid encoding at least a portion of the heavy chain of the antibody and a second nucleic acid encoding at least a portion of the light chain of the antibody, as well as vectors that include these isolated nucleic acid sequences. The disclosure provides methods of producing an anti-CD3ε antibody by culturing a cell under conditions that lead to expression of the anti-CD3ε antibody, wherein the cell comprises such a nucleic acid molecule(s). In some embodiments, the cell comprises such a vector.

The disclosure also provides activatable antibodies and activatable antibody compositions that include an antibody or antigen-binding fragment thereof (AB) that specifically binds CD3ε coupled or otherwise attached to a masking moiety (MM), such that coupling of the MM reduces the ability of the AB to bind CD3ε. These activatable antibodies are collectively referred to herein as activatable anti-CD3ε antibodies, also referred to herein as anti-CD3ε activatable antibodies or CD3ε activatable antibodies. In some embodiments, the MM is coupled via a sequence that includes a substrate for a protease. For example, the protease is produced by a tumor that is in proximity to cells that express CD3ε. In some embodiments, the protease is produced by a tumor that is co-localized with cells that express CD3ε. The activatable anti-CD3ε antibodies provided herein are stable in circulation, activated at intended sites of therapy and/or diagnosis but not in normal, i.e., healthy tissue, and, when activated, exhibit binding to CD3ε that is at least comparable to the corresponding, unmodified antibody.

In some embodiments, the activatable anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); and a VH CDR3 sequence that includes at least the amino acid sequence HGNFGNSYVSWFAY (SEQ ID NO: 55).

In some embodiments, the activatable anti-CD3ε antibody or antigen-binding fragment thereof includes a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the activatable anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the activatable anti-CD3ε antibody or antigen-binding fragment thereof includes a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the activatable anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence TYAMN (SEQ ID NO: 53); a VH CDR2 sequence that includes a sequence that is at least 90%, 91%, 92%, 93%, 94%, 95%, 96%, 97%, 98%, 99% or more identical to the amino acid sequence RIRSKYNNYATYYADSVKD (SEQ ID NO: 54); and a VH CDR3 sequence that includes a sequence that is at least 90%, 91%, 92%, 93%, 94%, 95%, 96%, 97%, 98%, 99% or more identical to the amino acid sequence HGNFGNSYVSWFAY (SEQ ID NO: 55).

In some embodiments, the activatable anti-CD3ε antibody or antigen-binding fragment thereof includes a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that includes a sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that includes a sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the activatable anti-CD3ε antibody or antigen-binding fragment thereof includes a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence TYAMN (SEQ ID NO: 53); a VH CDR2 sequence that includes a sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that includes a sequence that is at least 90%, 91%, 92%, 93%, 94%, 95%, 96%, 97%, 98%, 99% or more identical to the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that includes a sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that includes a sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the activatable anti-CD3ε antibody or antigen-binding fragment thereof includes a VH CDR1 sequence that is at least 90%, 91%, 92%, 93%, 94%, 95%, 96%, 97%, 98%, 99% or more identical to the amino acid sequence TYAMN (SEQ ID NO: 53); a VH CDR2 sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that is at least 90%, 91%, 92%, 93%, 94%, 95%, 96%, 97%, 98%, 99% or more identical to the amino acid sequence HGNFGNSYVSWFAY (SEQ ID NO: 55), a VL CDR1 sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 18; a VH CDR2 sequence shown in Table 18; a VH CDR3 sequence shown in Table 18; a VL CDR1 sequence shown in Table 18; a VL CDR2 sequence shown in Table 18; and a VL CDR3 sequence shown in Table 18.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 18; a VH CDR2 sequence that includes a sequence that is at least 90%, 91%, 92%, 93%, 94%, 95%, 96%, 97%, 98%, 99% or more identical to a VH CDR2 sequence shown in Table 18; a VH CDR3 sequence that includes a sequence that is at least 90%, 91%, 92%, 93%, 94%, 95%, 96%, 97%, 98%, 99% or more identical to a VH CDR3 sequence shown in Table 18; a VL CDR1 sequence that includes a sequence that is at least 90%, 91%, 92%, 93%, 94%, 95%, 96%, 97%, 98%, 99% or more identical to a VL CDR1 sequence shown in Table 18; a VL CDR2 sequence that includes a sequence that is at least 90%, 91%, 92%, 93%, 94%, 95%, 96%, 97%, 98%, 99% or more identical to a VL CDR2 sequence shown in Table 18; and a VL CDR3 sequence that includes a sequence that is at least 90%, 91%, 92%, 93%, 94%, 95%, 96%, 97%, 98%, 99% or more identical to a VL CDR3 sequence shown in Table 18.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination shown in Table 18.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination shown in Table 18.

In some embodiments, the activatable anti-CD3ε antibody or antigen-binding fragment thereof includes a variable heavy chain (Hv) comprising the amino acid sequence of SEQ ID NO: 4. In some embodiments, the anti-CD3ε antibody or antigen-binding fragment thereof includes a variable light chain (Lv) comprising the amino acid sequence of SEQ ID NO: 2. In some embodiments, the anti-CD3ε antibody or antigen-binding fragment thereof includes a variable heavy chain (Hv) comprising the amino acid sequence of SEQ ID NO: 4 and a variable light chain (Lv) comprising the amino acid sequence of SEQ ID NO: 2.

In some embodiments, the activatable anti-CD3ε antibody or antigen-binding fragment thereof includes a variable heavy chain (Hv) comprising an amino acid sequence that is at least 90%, 91%, 92%, 93%, 94%, 95%, 96%, 97%, 98%, 99% or more identical to the amino acid sequence of SEQ ID NO: 4. In some embodiments, the anti-CD3ε antibody or antigen-binding fragment thereof includes a variable light chain (Lv) comprising an amino acid sequence that is at least 90%, 91%, 92%, 93%, 94%, 95%, 96%, 97%, 98%, 99% or more identical to the amino acid sequence of SEQ ID NO: 2. In some embodiments, the anti-CD3ε antibody or antigen-binding fragment thereof includes a variable heavy chain (Hv) comprising an amino acid sequence that is at least 90%, 91%, 92%, 93%, 94%, 95%, 96%, 97%, 98%, 99% or more identical to the amino acid sequence of SEQ ID NO: 4 and a variable light chain (Lv) comprising the amino acid sequence of SEQ ID NO: 2.

In some embodiments, the activatable anti-CD3ε antibody includes an scFv antibody fragment that binds CD3ε. In some embodiments, the anti-CD3ε scFv antibody fragment includes the amino acid sequence of SEQ ID NO: 6. In some embodiments, the anti-CD3ε scFv antibody fragment includes the amino acid sequence of SEQ ID NO: 30. In some embodiments, the anti-CD3ε scFv antibody fragment includes an amino acid sequence that is at least 90%, 91%, 92%, 93%, 94%, 95%, 96%, 97%, 98%, 99% or more identical to the amino acid sequence of SEQ ID NO: 6. In some embodiments, the anti-CD3ε scFv antibody fragment includes an amino acid sequence that is at least 90%, 91%, 92%, 93%, 94%, 95%, 96%, 97%, 98%, 99% or more identical to the amino acid sequence of SEQ ID NO: 30.

In some embodiments, the activatable antibody comprises a heavy chain amino acid sequence selected from the group consisting of the heavy chain sequences shown in Table 17. In some embodiments, the activatable antibody comprises a light chain amino acid sequence selected from the group consisting of the light chain sequences shown in Table 17. In some embodiments, the activatable antibody comprises a heavy chain amino acid sequence selected from the group consisting of the heavy chain sequences shown in Table 17 and a light chain amino acid sequence selected from the group consisting of the light chain sequences shown in Table 17.

In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 17. In some embodiments, the activatable antibody comprises a light chain amino acid sequence that is at least 90%, 91%, 92%, 93%, 94%, 95%, 96%, 97%, 98% or 99% identical to an amino acid sequence selected from the group consisting of the light chain sequences shown in Table 17. In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 17 and a light chain amino acid sequence that is at least 90%, 91%, 92%, 93%, 94%, 95%, 96%, 97%, 98% or 99% identical to an amino acid sequence selected from the group consisting of the light chain sequences shown in Table 17.

In some embodiments, the MM has a dissociation constant, i.e., dissociation constant at an equilibrium state, $K_d$ for binding to the AB that is greater than the $K_d$ for binding of the AB to CD3ε.

In some embodiments, the MM has a $K_d$ for binding to the AB that is no more than the $K_d$ for binding of the AB to CD3ε.

In some embodiments, the MM has a $K_d$ for binding to the AB that is no less than the $K_d$ for binding of the AB to CD3ε.

In some embodiments, the MM has a $K_d$ for binding to the AB that is approximately equal to the $K_d$ for binding of the AB to CD3ε.

In some embodiments, the MM has a $K_d$ for binding to the AB that is less than the $K_d$ for binding of the AB to CD3ε.

In some embodiments, the MM has a $K_d$ for binding to the AB that is no more than 2, 3, 4, 5, 10, 25, 50, 100, 250, 500, or 1,000 fold greater than the $K_d$ for binding of the AB to CD3ε. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to CD3ε.

In some embodiments, the MM has an affinity for binding to the AB that is less than the affinity of binding of the AB to CD3ε.

In some embodiments, the MM has an affinity for binding to the AB that is no more than the affinity of binding of the AB to CD3ε.

In some embodiments, the MM has an affinity for binding to the AB that is approximately equal of the affinity of binding of the AB to CD3ε.

In some embodiments, the MM has an affinity for binding to the AB that is no less than the affinity of binding of the AB to CD3ε.

In some embodiments, the MM has an affinity for binding to the AB that is greater than the affinity of binding of the AB to CD3ε.

In some embodiments, the MM has an affinity for binding to the AB that is 2, 3, 4, 5, 10, 25, 50, 100, 250, 500, or 1,000 fold less than the affinity of binding of the AB to CD3ε. In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to CD3ε. In some embodiments, the MM has an affinity for binding to the AB that is 2 to 20 fold less than the affinity of binding of the AB to CD3ε. In some embodiments, a MM not covalently linked to the AB and at equimolar concentration to the AB does not inhibit the binding of the AB to CD3ε.

In some embodiments, the MM does not interfere or compete with the AB for binding to CD3ε when the activatable antibody is in a cleaved state.

In some embodiments, the MM is a polypeptide of no more than 40 amino acids in length.

In some embodiments, the MM polypeptide sequence is different from that of CD3ε. In some embodiments, the MM polypeptide sequence is no more than 50% identical to any natural binding partner of the AB. In some embodiments, the MM polypeptide sequence is no more than 25% identical to any natural binding partner of the AB. In some embodiments, the MM polypeptide sequence is no more than 10% identical to any natural binding partner of the AB.

In some embodiments, the MM comprises a sequence selected from the group consisting of the sequences shown in Table 7 or Table 8.

In some embodiments, the protease is produced by a tumor that is in proximity to cells that express CD3ε and/or is produced by a tumor that is co-localized with cells that express CD3ε in a tissue, and wherein the protease cleaves the CM in the activatable antibody when the activatable antibody is exposed to the protease. In some embodiments, the CM is a polypeptide of up to 15 amino acids in length. In some embodiments, the CM is a substrate for a protease selected from the proteases listed in Table 3. In some embodiments, the CM is a substrate for a protease selected from the group consisting of uPA, legumain, matriptase (also referred to herein as MT-SP1 or MTSP1), ADAM17, BMP-1, TMPRSS3, TMPRSS4, MMP-9, MMP-12, MMP-13, MMP-14, and any of those shown in Table 3. In some embodiments, the CM is a substrate for an protease selected from the group consisting of uPA, legumain, and matriptase. In some embodiments, the CM is a substrate for a matrix metalloprotease (MMP).

In some embodiments, the antigen binding fragment thereof is selected from the group consisting of a Fab fragment, a F(ab')$_2$ fragment, a scFv, a scab, a dAb, a single domain heavy chain antibody, and a single domain light chain antibody.

In some embodiments, the activatable antibody in the uncleaved state has the structural arrangement from N-terminus to C-terminus as follows: MM-CM-AB or AB-CM-MM. In some embodiments, the activatable antibody comprises a linking peptide between the MM and the CM. In some embodiments, the activatable antibody comprises a linking peptide between the CM and the AB. In some embodiments, the activatable antibody comprises a first linking peptide (LP1) and a second linking peptide (LP2), wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other. In some embodiments, each of LP1 and LP2 is a peptide of about 1 to 20 amino acids in length.

In some embodiments, the activatable anti-CD3ε antibody also includes an agent conjugated to the activatable antibody. In some embodiments, the agent is a therapeutic agent.

In some embodiments, the agent is a detectable moiety. In some embodiments, the detectable moiety is a diagnostic agent. In some embodiments, the agent is conjugated to the activatable anti-CD3ε antibody via a linker. In some embodiments, the linker is a cleavable linker. In some embodiments, the linker is a non-cleavable linker.

The disclosure also provides multispecific antibodies that bind the epsilon chain of CD3 (CD3ε) and a second target, wherein the antibody comprises a first antibody or antigen-binding fragment thereof (AB1) that binds the epsilon chain of CD3 (CD3ε) and a second antibody or antigen-binding fragment thereof (AB2) that binds a second target, and wherein AB1 comprises a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the activatable antibodies described herein in an activated state bind CD3ε and include (i) an antibody or an antigen binding fragment thereof (AB) that specifically binds to CD3ε; (ii) a masking moiety (MM) that inhibits the binding of the AB to CD3ε when the activatable antibody is in an uncleaved state; and (c) a cleavable moiety (CM) coupled to the AB, wherein the CM is a polypeptide that functions as a substrate for a protease. In some embodiments, the MM is coupled to the AB via the CM.

In some embodiments, the activatable antibody in the uncleaved state has the structural arrangement from N-terminus to C-terminus as follows: MM-CM-AB or AB-CM-MM.

In some embodiments, the activatable antibody comprises a linking peptide between the MM and the CM.

In some embodiments, the activatable antibody comprises a linking peptide between the CM and the AB.

In some embodiments, the activatable antibody comprises a first linking peptide (LP1) and a second linking peptide (LP2), and the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other.

In some embodiments, at least one of LP1 or LP2 includes an amino acid sequence selected from the group consisting of $(GS)_n$, $(GGS)_n$, $(GSGGS)_n$ (SEQ ID NO: 59) and $(GGGS)_n$ (SEQ ID NO: 60), where n is an integer of at least one. In some embodiments, at least one of LP1 or LP2 includes an amino acid sequence selected from the group consisting of GGSG (SEQ ID NO: 61), GGSGG (SEQ ID NO: 62), GSGSG (SEQ ID NO: 63), GSGGG (SEQ ID NO: 64), GGGSG (SEQ ID NO: 65), and GSSSG (SEQ ID NO: 66).

In some embodiments, the activatable antibody includes an antibody or antigen-binding fragment thereof that specifically binds CD3ε. In some embodiments, the antibody or antigen-binding fragment thereof that binds CD3ε is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen-binding fragment thereof that binds CD3ε is a rodent (e.g., mouse or rat), chimeric, humanized or fully human monoclonal antibody.

In some embodiments, the AB has a dissociation constant of about 100 nM or less for binding to CD3ε.

In some embodiments, the MM has a dissociation constant, i.e., dissociation constant at an equilibrium state, $K_d$ for binding to the AB that is greater than the $K_d$ for binding of the AB to CD3ε.

In some embodiments, the MM has a $K_d$ for binding to the AB that is no more than the $K_d$ for binding of the AB to CD3ε.

In some embodiments, the MM has a $K_d$ for binding to the AB that is no less than the $K_d$ for binding of the AB to CD3ε.

In some embodiments, the MM has a $K_d$ for binding to the AB that is approximately equal to the $K_d$ for binding of the AB to CD3ε.

In some embodiments, the MM has a $K_d$ for binding to the AB that is less than the $K_d$ for binding of the AB to CD3ε.

In some embodiments, the MM has a $K_d$ for binding to the AB that is no more than 2, 3, 4, 5, 10, 25, 50, 100, 250, 500, or 1,000 fold greater than the $K_d$ for binding of the AB to CD3ε. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to CD3ε.

In some embodiments, the MM has an affinity for binding to the AB that is less than the affinity of binding of the AB to CD3ε.

In some embodiments, the MM has an affinity for binding to the AB that is no more than the affinity of binding of the AB to CD3ε.

In some embodiments, the MM has an affinity for binding to the AB that is approximately equal of the affinity of binding of the AB to CD3ε.

In some embodiments, the MM has an affinity for binding to the AB that is no less than the affinity of binding of the AB to CD3ε.

In some embodiments, the MM has an affinity for binding to the AB that is greater than the affinity of binding of the AB to CD3ε.

In some embodiments, the MM has an affinity for binding to the AB that is 2, 3, 4, 5, 10, 25, 50, 100, 250, 500, or 1,000 less than the affinity of binding of the AB to CD3ε. In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to CD3ε. In some embodiments, the MM has an affinity for binding to the AB that is 2 to 20 fold less than the affinity of binding of the AB to CD3ε. In some embodiments, a MM not covalently linked to the AB and at equimolar concentration to the AB does not inhibit the binding of the AB to CD3ε.

In some embodiments, the MM does not interfere or compete with the AB for binding to CD3ε when the activatable antibody is in a cleaved state.

In some embodiments, the MM is a polypeptide of about 2 to 40 amino acids in length. In some embodiments, the MM is a polypeptide of no more than 40 amino acids in length.

In some embodiments, the MM polypeptide sequence is different from that of CD3ε. In some embodiments, the MM polypeptide sequence is no more than 50% identical to any natural binding partner of the AB. In some embodiments, the MM polypeptide sequence is different from that of CD3ε and wherein the MM polypeptide sequence is no more than 25% identical to any natural binding partner of the AB. In some embodiments, the MM polypeptide sequence is different from that of CD3ε and wherein the MM polypeptide sequence is no more than 10% identical to any natural binding partner of the AB.

In some embodiments, the coupling of the MM reduces the ability of the AB to bind CD3ε such that the dissociation constant ($K_d$) of the AB when coupled to the MM towards CD3ε is at least 20 times greater than the $K_d$ of the AB when not coupled to the MM towards CD3ε.

In some embodiments, the coupling of the MM reduces the ability of the AB to bind CD3ε such that the dissociation constant ($K_d$) of the AB when coupled to the MM towards CD3ε is at least 40 times greater than the $K_d$ of the AB when not coupled to the MM towards CD3ε.

In some embodiments, the coupling of the MM reduces the ability of the AB to bind CD3ε such that the dissociation constant ($K_d$) of the AB when coupled to the MM towards CD3ε is at least 100 times greater than the $K_d$ of the AB when not coupled to the MM towards CD3ε.

In some embodiments, the coupling of the MM reduces the ability of the AB to bind CD3ε such that the dissociation constant ($K_d$) of the AB when coupled to the MM towards CD3ε is at least 1000 times greater than the $K_d$ of the AB when not coupled to the MM towards CD3ε.

In some embodiments, the coupling of the MM reduces the ability of the AB to bind CD3ε such that the dissociation constant ($K_d$) of the AB when coupled to the MM towards CD3ε is at least 10,000 times greater than the $K_d$ of the AB when not coupled to the MM towards CD3ε.

In some embodiments, in the presence of CD3ε, the MM reduces the ability of the AB to bind CD3ε by at least 90% when the CM is uncleaved, as compared to when the CM is cleaved when assayed in vitro using a target displacement assay such as, for example, the assay described in PCT Publication No. WO 2010/081173, the contents of which are hereby incorporated by reference in their entirety.

In some embodiments, the MM does not interfere or compete with the AB of the activatable antibody in a cleaved state for binding to the CD3ε target.

In some embodiments, the MM is an amino acid sequence selected from the group of those listed in Tables 7 or 8.

In some embodiments, the protease is produced by a tumor that is in proximity to cells that express CD3ε and/or produced by a tumor that is co-localized with CD3ε in a tissue, and the protease cleaves the CM in the activatable antibody when the activatable antibody is exposed to the protease.

In some embodiments, the CM is positioned in the activatable antibody such that when the activatable antibody is in the uncleaved state, binding of the activatable antibody to CD3ε is reduced to occur with a dissociation constant that is at least 20-fold greater than the dissociation constant of an unmodified AB binding to CD3ε, and whereas when the activatable antibody is in the cleaved state, the AB binds CD3ε.

In some embodiments, the CM is positioned in the activatable antibody such that when the activatable antibody is in the uncleaved state, binding of the activatable antibody to CD3ε is reduced to occur with a dissociation constant that is at least 40-fold greater than the dissociation constant of an unmodified AB binding to CD3ε, and whereas when the activatable antibody is in the cleaved state, the AB binds CD3ε.

In some embodiments, the CM is positioned in the activatable antibody such when the activatable antibody is that in the uncleaved state, binding of the activatable antibody to CD3ε is reduced to occur with a dissociation constant that is at least 50-fold greater than the dissociation constant of an unmodified AB binding to CD3ε, and whereas when the activatable antibody is in the cleaved state, the AB binds CD3ε.

In some embodiments, the CM is positioned in the activatable antibody such that when the activatable antibody is in the uncleaved state, binding of the activatable antibody to CD3ε is reduced to occur with a dissociation constant that is at least 100-fold greater than the dissociation constant of an unmodified AB binding to CD3ε, and whereas when the activatable antibody is in the cleaved state, the AB binds CD3ε.

In some embodiments, the CM is positioned in the activatable antibody such that when the activatable antibody is in the uncleaved state, binding of the activatable antibody to CD3ε is reduced to occur with a dissociation constant that is at least 200-fold greater than the dissociation constant of an unmodified AB binding to CD3ε, and whereas when the activatable antibody is in the cleaved state, the AB binds CD3ε.

In some embodiments, the CM is a polypeptide of up to 15 amino acids in length.

In some embodiments, the CM includes the amino acid sequence LSGRSDNH (SEQ ID NO: 67). In some embodiments, the cleavable moiety is selected for use with a specific protease, for example a protease that is known to be produced by a tumor that is in proximity to cells that express the target of the activatable antibody, e.g., CD3ε, and/or produced by a tumor that is co-localized with the target of the activatable antibody. For example, suitable cleavable moieties for use in the activatable anti-CD3ε antibodies of the disclosure are cleaved by at least a protease such as urokinase, legumain, and/or matriptase (also referred to herein as MT-SP1 or MTSP1). In some embodiments, a suitable cleavable moiety includes at least one of the following sequences: TGRGPSWV (SEQ ID NO: 68); SARGPSRW (SEQ ID NO: 69); TARGPSFK (SEQ ID NO: 70); LSGRSDNH (SEQ ID NO: 67); GGWHTGRN (SEQ ID NO: 71); HTGRSGAL (SEQ ID NO: 72); PLTGRSGG (SEQ ID NO: 73); AARGPAIH (SEQ ID NO: 74); RGPAFNPM (SEQ ID NO: 75); SSRGPAYL (SEQ ID NO: 76); RGPATPIM (SEQ ID NO: 77); RGPA (SEQ ID NO: 78); GGQPSGMWGW (SEQ ID NO: 79); FPRPLGITGL (SEQ ID NO: 80); VHMPLGFLGP (SEQ ID NO: 81); SPLTGRSG (SEQ ID NO: 82); SAGFSLPA (SEQ ID NO: 83); LAPLGLQRR (SEQ ID NO: 84); SGGPLGVR (SEQ ID NO: 85); and/or PLGL (SEQ ID NO: 86).

In some embodiments, the CM comprises the amino acid sequence LSGRSDNH (SEQ ID NO: 67). In some embodiments, the CM comprises the amino acid sequence TGRGPSWV (SEQ ID NO: 68). In some embodiments, the CM comprises the amino acid sequence SARGPSRW (SEQ ID NO: 69). In some embodiments, the CM comprises the amino acid sequence TARGPSFK (SEQ ID NO: 70). In some embodiments, the CM comprises the amino acid sequence LSGRSDNH (SEQ ID NO: 67). In some embodiments, the CM comprises the amino acid sequence GGWHTGRN (SEQ ID NO: 71). In some embodiments, the CM comprises the amino acid sequence HTGRSGAL (SEQ ID NO: 72). In some embodiments, the CM comprises the amino acid sequence PLTGRSGG (SEQ ID NO: 73). In some embodiments, the CM comprises the amino acid sequence AARGPAIH (SEQ ID NO: 74). In some embodiments, the CM comprises the amino acid sequence RGPAFNPM (SEQ ID NO: 75). In some embodiments, the CM comprises the amino acid sequence SSRGPAYL (SEQ ID NO: 76). In some embodiments, the CM comprises the amino acid sequence RGPATPIM (SEQ ID NO: 77). In some embodiments, the CM comprises the amino acid sequence RGPA (SEQ ID NO: 78). In some embodiments, the CM comprises the amino acid sequence GGQPSGMWGW (SEQ ID NO: 79). In some embodiments, the CM comprises the amino acid sequence FPRPLGITGL (SEQ ID NO: 80). In some embodiments, the CM comprises the amino acid sequence VHMPLGFLGP (SEQ ID NO: 81). In some embodiments, the CM comprises the amino acid sequence SPLTGRSG (SEQ ID NO: 82). In some embodiments, the CM comprises the amino acid sequence SAGFSLPA (SEQ ID NO: 83). In some embodiments, the CM comprises the amino acid sequence LAPLGLQRR (SEQ ID NO: 84). In some embodiments, the CM comprises the amino acid sequence SGGPLGVR (SEQ ID NO: 85). In some embodiments, the CM comprises the amino acid sequence PLGL (SEQ ID NO: 86).

In some embodiments, the CM is a substrate for an MMP and includes the sequence ISSGLLSS (SEQ ID NO: 321); QNQALRMA (SEQ ID NO: 322); AQNLLGMV (SEQ ID NO: 323); STFPFGMF (SEQ ID NO: 324); PVGYTSSL (SEQ ID NO: 325); DWLYWPGI (SEQ ID NO: 326); MIAPVAYR (SEQ ID NO: 327); RPSPMWAY (SEQ ID NO: 328); WATPRPMR (SEQ ID NO: 329); FRLLDWQW (SEQ ID NO: 330); LKAAPRWA (SEQ ID NO: 331); GPSHLVLT (SEQ ID NO: 332); LPGGLSPW (SEQ ID NO: 333); MGLFSEAG (SEQ ID NO: 334); SPLPLRVP (SEQ ID NO: 335); RMHLRSLG (SEQ ID NO: 336); LAAPLGLL (SEQ ID NO: 337); AVGLLAPP (SEQ ID NO: 338); LLAPSHRA (SEQ ID NO: 339); PAGLWLDP (SEQ ID NO: 340); and/or ISSGLSS (SEQ ID NO: 341).

In some embodiments, the CM comprises the amino acid sequence ISSGLLSS (SEQ ID NO: 321). In some embodiments, the CM comprises the amino acid sequence QNQALRMA (SEQ ID NO: 322). In some embodiments, the CM comprises the amino acid sequence AQNLLGMV (SEQ ID NO: 323). In some embodiments, the CM comprises the amino acid sequence STFPFGMF (SEQ ID NO: 324). In some embodiments, the CM comprises the amino acid sequence PVGYTSSL (SEQ ID NO: 325). In some embodiments, the CM comprises the amino acid sequence DWLYWPGI (SEQ ID NO: 326). In some embodiments, the CM comprises the amino acid sequence MIAPVAYR (SEQ ID NO: 327). In some embodiments, the CM comprises the amino acid sequence RPSPMWAY (SEQ ID NO: 328). In some embodiments, the CM comprises the amino acid sequence WATPRPMR (SEQ ID NO: 329). In some embodiments, the CM comprises the amino acid sequence FRLLDWQW (SEQ ID NO: 330). In some embodiments, the CM comprises the amino acid sequence LKAAPRWA (SEQ ID NO: 331). In some embodiments, the CM comprises the amino acid sequence GPSHLVLT (SEQ ID NO: 332). In some embodiments, the CM comprises the amino acid sequence LPGGLSPW (SEQ ID NO: 333). In some embodiments, the CM comprises the amino acid sequence MGLFSEAG (SEQ ID NO: 334). In some embodiments, the CM comprises the amino acid sequence SPLPLRVP (SEQ ID NO: 335). In some embodiments, the CM comprises the amino acid sequence RMHLRSLG (SEQ ID NO: 336). In some embodiments, the CM comprises the amino acid sequence LAAPLGLL (SEQ ID NO: 337). In some embodiments, the CM comprises the amino acid sequence AVGLLAPP (SEQ ID NO: 338). In some embodiments, the CM comprises the amino acid sequence LLAPSHRA (SEQ ID NO: 339). In some embodiments, the CM comprises the amino acid sequence PAGLWLDP (SEQ ID NO: 340). In some embodiments, the CM comprises the amino acid sequence ISSGLSS (SEQ ID NO: 341).

In some embodiments, the CM is a substrate for thrombin. In some embodiments, the CM is a substrate for thrombin and includes the sequence GPRSFGL (SEQ ID NO: 896) or GPRSFG (SEQ ID NO: 897). In some embodiments, the CM comprises the amino acid sequence GPRSFGL (SEQ ID NO: 896). In some embodiments, the CM comprises the amino acid sequence GPRSFG (SEQ ID NO: 897).

In some embodiments, the CM comprises an amino acid sequence selected from the group consisting of NTLSGRSENHSG (SEQ ID NO: 898); NTLSGRSGNHGS (SEQ ID NO: 899); TSTSGRSANPRG (SEQ ID NO: 900); TSGRSANP (SEQ ID NO: 901); VAGRSMRP (SEQ ID NO: 902); VVPEGRRS (SEQ ID NO: 903); ILPRSPAF (SEQ ID NO: 904); MVLGRSLL (SEQ ID NO: 905); QGRAITFI (SEQ ID NO: 906); SPRSIMLA (SEQ ID NO: 907); and SMLRSMPL (SEQ ID NO: 908).

In some embodiments, the CM comprises the amino acid sequence NTLSGRSENHSG (SEQ ID NO: 898). In some embodiments, the CM comprises the amino acid sequence NTLSGRSGNHGS (SEQ ID NO: 899). In some embodiments, the CM comprises the amino acid sequence TSTSGRSANPRG (SEQ ID NO: 900). In some embodiments, the CM comprises the amino acid sequence TSGRSANP (SEQ ID NO: 901). In some embodiments, the CM comprises the amino acid sequence VAGRSMRP (SEQ ID NO: 902). In some embodiments, the CM comprises the amino acid sequence VVPEGRRS (SEQ ID NO: 903). In some embodiments, the CM comprises the amino acid sequence ILPRSPAF (SEQ ID NO: 904). In some embodiments, the CM comprises the amino acid sequence MVLGRSLL (SEQ ID NO: 905). In some embodiments, the CM comprises the amino acid sequence QGRAITFI (SEQ ID NO: 906). In some embodiments, the CM comprises the amino acid sequence SPRSIMLA (SEQ ID NO: 907). In some embodiments, the CM comprises the amino acid sequence and SMLRSMPL (SEQ ID NO: 908).

In some embodiments, the CM is a substrate for a neutrophil elastase. In some embodiments, the CM is a substrate for a serine protease. In some embodiments, the CM is a substrate for uPA. In some embodiments, the CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, the CM is a CM1-CM2 substrate and includes the sequence ISSGLLSGRSDNH (SEQ ID NO: 909); ISSGLLSSGGSGGSLSGRSDNH (SEQ ID NO: 910); AVGLLAPPGGTSTSGRSANPRG (SEQ ID NO: 911); TSTSGRSANPRGGGAVGLLAPP (SEQ ID NO: 912); VHMPLGFLGPGGTSTSGRSANPRG (SEQ ID NO: 913); TSTSGRSANPRGGGVHMPLGFLGP (SEQ ID NO: 914); AVGLLAPPGGLSGRSDNH (SEQ ID NO: 915); LSGRSDNHGGAVGLLAPP (SEQ ID NO: 916); VHMPLGFLGPGGLSGRSDNH (SEQ ID NO: 917); LSGRSDNHGGVHMPLGFLGP (SEQ ID NO: 918); LSGRSDNHGGSGGSISSGLLSS (SEQ ID NO: 919); LSGRSGNHGGSGGSISSGLLSS (SEQ ID NO: 920); ISSGLLSSGGSGGSLSGRSGNH (SEQ ID NO: 921); LSGRSDNHGGSGGSQNQALRMA (SEQ ID NO: 922); QNQALRMAGGSGGSLSGRSDNH (SEQ ID NO: 923); LSGRSGNHGGSGGSQNQALRMA (SEQ ID NO: 924);

QNQALRMAGGSGGGSLSGRSGNH (SEQ ID NO: 925) and/or ISSGLLSGRSGNH (SEQ ID NO: 926).

In some embodiments, the CM1-CM2 substrate includes the sequence ISSGLLSGRSDNH (SEQ ID NO: 909). In some embodiments, the CM1-CM2 substrate comprises the amino acid sequence ISSGLLSSGGSGGSLSGRSDNH (SEQ ID NO: 910). In some embodiments, the CM1-CM2 substrate comprises the amino acid sequence AVGLLAPPGGTSTSGRSANPRG (SEQ ID NO: 911). In some embodiments, the CM1-CM2 substrate comprises the amino acid sequence TSTSGRSANPRGGGAVGLLAPP (SEQ ID NO: 912). In some embodiments, the CM1-CM2 substrate comprises the amino acid sequence VHMPLGFLGPGGTSTSGRSANPRG (SEQ ID NO: 913). In some embodiments, the CM1-CM2 substrate comprises the amino acid sequence TSTSGRSANPRGGGVHMPLGFLGP (SEQ ID NO: 914). In some embodiments, the CM1-CM2 substrate comprises the amino acid sequence AVGLLAPPGGLSGRSDNH (SEQ ID NO: 915). In some embodiments, the CM1-CM2 substrate comprises the amino acid sequence LSGRSDNHGGAVGLLAPP (SEQ ID NO: 916). In some embodiments, the CM1-CM2 substrate comprises the amino acid sequence VHMPLGFLGPGGLSGRSDNH (SEQ ID NO: 917). In some embodiments, the CM1-CM2 substrate comprises the amino acid sequence LSGRSDNHGGVHMPLGFLGP (SEQ ID NO: 918). In some embodiments, the CM1-CM2 substrate comprises the amino acid sequence LSGRSDNHGGSGGSISSGLLSS (SEQ ID NO: 919). In some embodiments, the CM1-CM2 substrate comprises the amino acid sequence LSGRSGNHGGSGGSISSGLLSS (SEQ ID NO: 920). In some embodiments, the CM1-CM2 substrate comprises the amino acid sequence ISSGLLSSGGSGGSLSGRSGNH (SEQ ID NO: 921). In some embodiments, the CM1-CM2 substrate comprises the amino acid sequence LSGRSDNHGGSGGSQNQALRMA (SEQ ID NO: 922). In some embodiments, the CM1-CM2 substrate comprises the amino acid sequence QNQALRMAGGSGGSLSGRSDNH (SEQ ID NO: 923). In some embodiments, the CM1-CM2 substrate comprises the amino acid sequence LSGRSGNHGGSGGSQNQALRMA (SEQ ID NO: 924). In some embodiments, the CM1-CM2 substrate comprises the amino acid sequence QNQALRMAGGSGGSLSGRSGNH (SEQ ID NO: 925). In some embodiments, the CM1-CM2 substrate comprises the amino acid sequence ISSGLLSGRSGNH (SEQ ID NO: 926).

In some embodiments, the CM is a substrate for a protease selected from the group consisting of those shown in Table 3. In some embodiments, the protease is selected from the group consisting of uPA, legumain, matriptase, ADAM17, BMP-1, TMPRSS3, TMPRSS4, MMP-9, MMP-12, MMP-13, and MMP-14. In some embodiments, the protease is a cathepsin. In some embodiments, the CM is a substrate for a protease selected from the group consisting of uPA (urokinase plasminogen activator), legumain and matriptase. In some embodiments, the protease comprises uPA. In some embodiments, the protease comprises legumain. In some embodiments, the protease comprises matriptase. In some embodiments, the protease comprises a matrix metalloproteinase (MMP).

In some embodiments, the CM is a substrate for at least two proteases. In some embodiments, each protease is selected from the group consisting of those shown in Table 3. In some embodiments, the CM is a substrate for at least two proteases, wherein one of the proteases is selected from the group consisting of uPA, legumain and matriptase and the other protease is selected from the group consisting of those shown in Table 3. In some embodiments, the CM is a substrate for at least two proteases selected from the group consisting of uPA, legumain and matriptase.

In some embodiments, the activatable antibody includes at least a first CM and a second CM. In some embodiments, the first CM and the second CM are each polypeptides of no more than 15 amino acids long. In some embodiments, the first CM and the second CM in the activatable antibody in the uncleaved state have the structural arrangement from N-terminus to C-terminus as follows: MM-CM1-CM2-AB or AB-CM2-CM1-MM. In some embodiments, at least one of the first CM and the second CM is a polypeptide that functions as a substrate for a protease selected from the group consisting of uPA, legumain, and matriptase. In some embodiments, the first CM is cleaved by a first cleaving agent selected from the group consisting of uPA, legumain, and matriptase in a target tissue and the second CM is cleaved by a second cleaving agent in a target tissue. In some embodiments, the other protease is selected from the group consisting of those shown in Table 3. In some embodiments, the first cleaving agent and the second cleaving agent are the same protease selected from the group consisting of uPA, legumain, and matriptase, and the first CM and the second CM are different substrates for the protease. In some embodiments, the first cleaving agent and the second cleaving agent are the same protease selected from the group consisting of those shown in Table 3. In some embodiments, the first cleaving agent and the second cleaving agent are different proteases. In some embodiments, the first cleaving agent and the second cleaving agent are produced by a tumor that is in proximity to cells that express the target and/or produced by a tumor that is co-localized in the target tissue. In some embodiments, the first CM and the second CM are cleaved by at least one cleaving agent in the target tissue.

In some embodiments, the activatable antibody is exposed to and cleaved by a protease such that, when the activatable antibody is in the activated or cleaved state, the activated antibody includes a light chain amino acid sequence that includes at least a portion of LP2 and/or CM sequence after the protease has cleaved the CM.

In some embodiments, the MM and the CM include an amino acid sequence selected from the group consisting of those presented herein.

In some embodiments, the activatable antibody also includes a signal peptide. In some embodiments, the signal peptide is conjugated to the activatable antibody via a spacer. In some embodiments, the spacer is conjugated to the activatable antibody in the absence of a signal peptide. In some embodiments, the spacer is joined directly to the MM of the activatable antibody.

In some embodiments, the activatable antibody in an uncleaved state comprises a spacer that is joined directly to the MM and has the structural arrangement from N-terminus to C-terminus of spacer-MM-CM-AB. In some embodiments, the spacer includes at least the amino acid sequence QGQSGQG (SEQ ID NO: 407). In some embodiments, the spacer includes at least the amino acid sequence QGQSGQ (SEQ ID NO: 87). In some embodiments, the spacer includes at least the amino acid sequence QGQSG (SEQ ID NO: 408). In some embodiments, the spacer includes at least the amino acid sequence QGQS (SEQ ID NO: 409). In some embodiments, the spacer includes at least the amino acid sequence QGQ (SEQ ID NO: 410). In some embodiments, the spacer includes at least the amino acid sequence QG (SEQ ID NO: 411). In some embodiments, the spacer includes at least the amino acid residue Q. In some embodiments, the MM and spacer comprise an amino acid sequence selected from the sequences listed in Table 7 or Table 8.

In some embodiments, the activatable antibody includes a heavy chain sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, 546, 879, and 883.

In some embodiments, the activatable antibody includes a light chain sequence selected from the group consisting of SEQ ID NOs: 448, 450, 458, 468, 474, 482, 484, 508, 516, 520, 881.

In some embodiments, the activatable antibody includes a heavy chain sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, 546, 879, and 883; and a light chain sequence selected from the group consisting of SEQ ID NOs: 448, 450, 458, 468, 474, 482, 484, 508, 516, 520, and 881.

In some embodiments, the activatable antibody includes a heavy chain sequence that is at least 90%, 91%, 92%, 93%, 94%, 95%, 96%, 97%, 98% or 99% identical to an amino acid sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, 546, 879, and 883.

In some embodiments, the activatable antibody includes a light chain sequence that is at least 90%, 91%, 92%, 93%, 94%, 95%, 96%, 97%, 98% or 99% identical to an amino acid sequence selected from the group consisting of SEQ ID NOs: 448, 450, 458, 468, 474, 482, 484, 508, 516, 520, and 881.

In some embodiments, the activatable antibody includes a heavy chain sequence that is at least 90%, 91%, 92%, 93%, 94%, 95%, 96%, 97%, 98% or 99% identical to an amino acid sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, 546, 879, and 883; and a light chain sequence that is at least 90%, 91%, 92%, 93%, 94%, 95%, 96%, 97%, 98% or 99% identical to an amino acid sequence selected from the group consisting of SEQ ID NOs: 448, 450, 458, 468, 474, 482, 484, 508, 516, 520, and 881.

In some embodiments, the activatable antibody includes the amino acid sequence of SEQ ID NO: 506. In some embodiments, the activatable antibody includes an amino acid sequence that is at least 90%, 91%, 92%, 93%, 94%, 95%, 96%, 97%, 98% or 99% identical to the amino acid sequence of SEQ ID NO: 506.

In some embodiments, the activatable antibody includes the amino acid sequence of SEQ ID NO: 587 or SEQ ID NO: 588. In some embodiments, the activatable antibody includes an amino acid sequence that is at least 90%, 91%, 92%, 93%, 94%, 95%, 96%, 97%, 98% or 99% identical to the amino acid sequence of SEQ ID NO: 587 or SEQ ID NO: 588.

In some embodiments, the activatable antibody also includes an agent conjugated to the AB. In some embodiments, the agent is a therapeutic agent. In some embodiments, the agent is a detectable moiety. In some embodiments, the detectable moiety is a diagnostic agent. In some embodiments, the agent is conjugated to the AB via a linker. In some embodiments, the linker is a cleavable linker. In some embodiments, the linker is a non-cleavable linker.

In some embodiments, the activatable antibody also includes a detectable moiety. In some embodiments, the detectable moiety is a diagnostic agent.

In some embodiments, the AB of the activatable antibody naturally contains one or more disulfide bonds. In some embodiments, the AB can be engineered to include one or more disulfide bonds.

In some embodiments, the serum half-life of the multispecific activatable antibody is longer than that of the corresponding multispecific antibody; e.g., the pK of the multispecific activatable antibody is longer than that of the corresponding multispecific antibody. In some embodiments, the serum half-life of the multispecific activatable antibody is similar to that of the corresponding multispecific antibody. In some embodiments, the serum half-life of the multispecific activatable antibody is at least 15 days when administered to an organism. In some embodiments, the serum half-life of the multispecific activatable antibody is at least 12 days when administered to an organism. In some embodiments, the serum half-life of the multispecific activatable antibody is at least 11 days when administered to an organism. In some embodiments, the serum half-life of the multispecific activatable antibody is at least 10 days when administered to an organism. In some embodiments, the serum half-life of the multispecific activatable antibody is at least 9 days when administered to an organism. In some embodiments, the serum half-life of the multispecific activatable antibody is at least 8 days when administered to an organism. In some embodiments, the serum half-life of the multispecific activatable antibody is at least 7 days when administered to an organism. In some embodiments, the serum half-life of the multispecific activatable antibody is at least 6 days when administered to an organism. In some embodiments, the serum half-life of the activatable antibody is at least 5 days when administered to an organism. In some embodiments, the serum half-life of the activatable antibody is at least 4 days when administered to an organism. In some embodiments, the serum half-life of the activatable antibody is at least 3 days when administered to an organism. In some embodiments, the serum half-life of the activatable antibody is at least 2 days when administered to an organism. In some embodiments, the serum half-life of the activatable antibody is at least 24 hours when administered to an organism. In some embodiments, the serum half-life of the activatable antibody is at least 20 hours when administered to an organism. In some embodiments, the serum half-life of the activatable antibody is at least 18 hours when administered to an organism. In some embodiments, the serum half-life of the activatable antibody is at least 16 hours when administered to an organism. In some embodiments, the serum half-life of the activatable antibody is at least 14 hours when administered to an organism. In some embodiments, the serum half-life of the activatable antibody is at least 12 hours when administered to an organism. In some embodiments, the serum half-life of the activatable antibody is at least 10 hours when administered to an organism. In some embodiments, the serum half-life of the activatable antibody is at least 8 hours when administered to an organism. In some embodiments, the serum half-life of the activatable antibody is at least 6 hours when administered to an organism. In some embodiments, the serum half-life of the activatable antibody is at least 4 hours when administered to an organism. In some embodiments, the serum half-life of the activatable antibody is at least 3 hours when administered to an organism.

In some embodiments, the activatable anti-CD3ε antibody is monospecific. In some embodiments, the activatable anti- CD3ε antibody is multispecific, e.g., by way of non-limiting example, bispecific or trifunctional. In some embodiments, the activatable anti-CD3ε antibody is formulated as part of a pro-Bispecific T Cell Engager (BITE) molecule. In some embodiments, the activatable anti-CD3ε antibody is formulated as part of a pro-Chimeric Antigen Receptor (CAR) modified T cell or other engineered receptor.

The compositions and methods provided herein enable the attachment of one or more agents to one or more cysteine residues in the AB without compromising the activity (e.g., the masking, activating or binding activity) of the activatable anti-CD3ε antibody. In some embodiments, the compositions and methods provided herein enable the attachment of one or more agents to one or more cysteine residues in the AB without reducing or otherwise disturbing one or more disulfide bonds within the MM. The compositions and methods provided herein produce an activatable anti-CD3ε antibody that is conjugated to one or more agents, e.g., any of a variety of therapeutic, diagnostic and/or prophylactic agents, preferably without any of the agent(s) being conjugated to the MM of the activatable anti-CD3ε antibody. The compositions and methods provided herein produce conjugated activatable anti-CD3ε antibodies in which the MM retains the ability to effectively and efficiently mask the AB of the activatable antibody in an uncleaved state. The compositions and methods provided herein produce conjugated activatable anti-CD3ε antibodies in which the activatable antibody is still activated, i.e., cleaved, in the presence of a protease that can cleave the CM.

In some embodiments, the anti-CD3ε antibodies and/or the activatable anti-CD3ε antibodies described herein are used in conjunction with one or more additional agents or a combination of additional agents. Suitable additional agents include current pharmaceutical and/or surgical therapies for an intended application, such as, for example, cancer. For example, the anti-CD3ε antibodies and/or activatable anti-CD3ε antibodies can be used in conjunction with an additional chemotherapeutic or anti-neoplastic agent.

In some embodiments, the anti-CD3ε antibody and/or activatable anti-CD3ε antibody and additional agent are formulated into a single therapeutic composition, and the anti-CD3ε antibody and/or activatable anti-CD3ε antibody and additional agent are administered simultaneously. In some embodiments, the anti-CD3ε antibody and/or activatable anti-CD3ε antibody and additional agent are separate from each other, e.g., each is formulated into a separate therapeutic composition, and the anti-CD3ε antibody and/or activatable anti-CD3ε antibody and the additional agent are administered simultaneously, or the anti-CD3ε antibody and/or activatable anti-CD3ε antibody and the additional agent are administered at different times during a treatment regimen. For example, the anti-CD3ε antibody and/or activatable anti-CD3ε antibody is administered prior to the administration of the additional agent, the anti-CD3ε antibody and/or activatable anti-CD3ε antibody is administered subsequent to the administration of the additional agent, or the anti-CD3ε antibody and/or activatable anti-CD3ε antibody and the additional agent are administered in an alternating fashion. As described herein, the anti-CD3ε antibody and/or activatable anti-CD3ε antibody and additional agent are administered in single doses or in multiple doses.

The disclosure also provides an isolated nucleic acid molecule encoding at least a portion of an activatable anti-CD3ε antibody described herein, as well as vectors that include these isolated nucleic acid sequences and/or one or more nucleic acid molecules encoding an anti-CD3ε antibody described herein, such as for example, at least a first nucleic acid encoding at least a portion of the heavy chain of the activatable antibody and a second nucleic acid encoding at least a portion of the light chain of the activatable antibody. The disclosure provides methods of producing an activatable antibody by culturing a cell under conditions that lead to expression of the activatable antibody, wherein the cell comprises such a nucleic acid molecule(s). In some embodiments, the cell comprises such a vector.

In some embodiments, the activatable antibody is encoded by a heavy chain nucleic acid sequence selected from the group consisting of SEQ ID NOs: 445, 451, 453, 455, 459, 461, 463, 465, 469, 471, 475, 477, 479, 485, 487, 489, 491, 493, 495, 497, 499, 501, 503, 511, 513, 517, 522, 525, 529, 531, 533, 535, 537, 539, 541, 543, 545, 878, and 882.

In some embodiments, the activatable antibody is encoded by a light chain nucleic acid selected from the group consisting of SEQ ID NOs: 447, 449, 457, 467, 473, 481, 483, 507, 515, 519, and 880

In some embodiments, the activatable antibody is encoded by a heavy chain nucleic acid sequence selected from the group consisting of SEQ ID NOs: 445, 451, 453, 455, 459, 461, 463, 465, 469, 471, 475, 477, 479, 485, 487, 489, 491, 493, 495, 497, 499, 501, 503, 511, 513, 517, 522, 525, 529, 531, 533, 535, 537, 539, 541, 543, 545, 878, and 882; and a light chain nucleic acid sequence selected from the group consisting of SEQ ID NOs: 447, 449, 457, 467, 473, 481, 483, 507, 515, 519, and 880.

In some embodiments, the activatable antibody is encoded by a heavy chain nucleic acid sequence that is at least 90%, 91%, 92%, 93%, 94%, 95%, 96%, 97%, 98% or 99% identical to a sequence selected from the group consisting of SEQ ID NOs: 445, 451, 453, 455, 459, 461, 463, 465, 469, 471, 475, 477, 479, 485, 487, 489, 491, 493, 495, 497, 499, 501, 503, 511, 513, 517, 522, 525, 529, 531, 533, 535, 537, 539, 541, 543, 545, 878, and 882.

In some embodiments, the activatable antibody is encoded by a light nucleic acid sequence that is at least 90%, 91%, 92%, 93%, 94%, 95%, 96%, 97%, 98% or 99% identical to a sequence selected from the group consisting of SEQ ID NOs: 447, 449, 457, 467, 473, 481, 483, 507, 515, and 519.

In some embodiments, the activatable antibody is encoded by a heavy chain nucleic acid sequence that is at least 90%, 91%, 92%, 93%, 94%, 95%, 96%, 97%, 98% or 99% identical to a sequence selected from the group consisting of SEQ ID NOs: 445, 451, 453, 455, 459, 461, 463, 465, 469, 471, 475, 477, 479, 485, 487, 489, 491, 493, 495, 497, 499, 501, 503, 511, 513, 517, 522, 525, 529, 531, 533, 535, 537, 539, 541, 543, 545, 878, and 882; and a light chain sequence that is at least 90%, 91%, 92%, 93%, 94%, 95%, 96%, 97%, 98% or 99% identical to a sequence selected from the group consisting of SEQ ID NOs: 447, 449, 457, 467, 473, 481, 483, 507, 515, 519, and 880.

In some embodiments, the activatable antibody is encoded by a nucleic acid that includes the nucleic acid sequence of SEQ ID NO: 505. In some embodiments, the activatable antibody includes a nucleic acid sequence that is at least 90%, 91%, 92%, 93%, 94%, 95%, 96%, 97%, 98% or 99% identical to the sequence of SEQ ID NO: 505.

The disclosure also provides a method of manufacturing activatable antibodies that binds CD3ε in an activated state by (a) culturing a cell comprising a nucleic acid construct that encodes the activatable antibody under conditions that lead to expression of the activatable antibody, wherein the activatable antibody comprises a masking moiety (MM), a cleavable moiety (CM), and an antibody or an antigen binding fragment thereof (AB) that specifically binds CD3ε, and (b) recovering the activatable antibody.

The disclosure also provides a method of manufacturing activatable antibodies that binds CD3ε in an activated state by (a) culturing a cell comprising a nucleic acid construct that encodes the activatable antibody under conditions that lead to expression of the activatable antibody, wherein the activatable antibody comprises a masking moiety (MM), a cleavable moiety (CM), and an antibody or an antigen binding fragment thereof (AB) that specifically binds CD3ε, (i) wherein the CM is a polypeptide that includes an amino acid sequence that functions as a substrate for a protease; and (ii) wherein the CM is positioned in the activatable antibody such that, when the activatable antibody is in an uncleaved state, the MM interferes with specific binding of the AB to CD3 and when the activatable antibody is in a cleaved state the MM does not interfere or compete with specific binding of the AB to CD3ε; and (b) recovering the activatable antibody.

The disclosure also provides multispecific antibodies that bind the epsilon chain of CD3 (CD3ε) and a second target, wherein the antibody comprises a first antibody or antigen-binding fragment thereof (AB1) that binds the epsilon chain of CD3 (CD3ε) and a second antibody or antigen-binding fragment thereof (AB2) that binds a second target, and wherein AB1 comprises a VH CDR1 sequence that includes an amino acid sequence that is at least 90%, 91%, 92%, 93%, 94%, 95%, 96%, 97%, 98%, 99% or more identical to the amino acid sequence TYAMN (SEQ ID NO: 53); a VH CDR2 sequence that includes an amino acid sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that includes an amino acid sequence that is at least 90%, 91%, 92%, 93%, 94%, 95%, 96%, 97%, 98%, 99% or more identical to the amino acid sequence HGNFGNSYVSWFAY (SEQ ID NO: 55), and a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes an amino acid sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that includes an amino acid sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that includes an amino acid sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the multispecific anti-CD3ε antibody or antigen-binding fragment thereof includes a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, AB1 comprises a variable heavy chain (Hv) comprising the amino acid sequence of SEQ ID NO: 4 and a variable light chain (Lv) comprising the amino acid sequence of SEQ ID NO: 2.

In some embodiments, AB1 comprises a variable heavy chain (Hv) comprising an amino acid sequence that is at least 90%, 91%, 92%, 93%, 94%, 95%, 96%, 97%, 98%, 99% or more identical to the amino acid sequence of SEQ ID NO: 4 and a variable light chain (Lv) comprising an amino acid sequence that is at least 90%, 91%, 92%, 93%, 94%, 95%, 96%, 97%, 98%, 99% or more identical to the amino acid sequence of SEQ ID NO: 2.

In some embodiments, AB1 comprises a scFv fragment. In some embodiments, the scFv fragment comprises the amino acid sequence of SEQ ID NO: 6. In some embodiments, the scFv fragment comprises the amino acid sequence of SEQ ID NO: 30. In some embodiments, the scFv fragment comprises an amino acid sequence that is at least 90%, 91%, 92%, 93%, 94%, 95%, 96%, 97%, 98%, 99% or more identical to the amino acid sequence of SEQ ID NO: 6. In some embodiments, the scFv fragment comprises an amino acid sequence that is at least 90%, 91%, 92%, 93%, 94%, 95%, 96%, 97%, 98%, 99% or more identical to the amino acid sequence of SEQ ID NO: 30.

In some embodiments, the multispecific antibody includes an agent conjugated to the antibody. In some embodiments, the agent is a therapeutic agent, a detectable moiety or a diagnostic agent. In some embodiments, the agent is conjugated to the antibody via a linker. In some embodiments, the linker is a cleavable linker. In some embodiments, the linker is a non-cleavable linker. In some embodiments, the linker is a non-cleavable linker.

The present disclosure also provides multispecific antibodies and multispecific activatable antibodies that bind at least CD3ε. The multispecific antibodies provided herein are antibodies that recognize two or more different antigens or epitopes, where at least one antigen or epitope is CD3ε. The multispecific activatable antibodies provided herein are multispecific antibodies that include at least one masking moiety (MM) linked to at least one antigen- or epitope-binding domain of the multispecific antibody such that coupling of the MM reduces the ability of the antigen- or epitope-binding domain to bind its target. In some embodiments, the MM is coupled to the antigen- or epitope-binding domain of the multispecific antibody via a cleavable moiety (CM) that functions as a substrate for a protease. The activatable multispecific antibodies provided herein are stable in circulation, activated at intended sites of therapy and/or diagnosis but not in normal, i.e., healthy tissue, and, when activated, exhibit binding to a target that is at least comparable to the corresponding, unmodified multispecific antibody.

In some embodiments, the multispecific antibodies and/or multispecific activatable antibodies are designed to engage immune effector cells, also referred to herein as immune effector cell engaging multispecific antibodies and/or immune effector cell engaging multispecific activatable antibodies. In some embodiments, the multispecific antibodies and/or multispecific activatable antibodies are designed to engage leukocytes, also referred to herein as leukocyte engaging multispecific antibodies and/or leukocyte engaging multispecific activatable antibodies. In some embodiments, the multispecific antibodies and/or multispecific activatable antibodies are designed to engage T cells, also referred to herein as T-cell engaging multispecific antibodies and/or T-cell engaging multispecific activatable antibodies. In some embodiments, the multispecific antibodies and/or multispecific activatable antibodies engage a surface antigen on a leukocyte, such as on a T cell, on a natural killer (NK) cell, on a myeloid mononuclear cell, on a macrophage, and/or on another immune effector cell. In some embodiments, the immune effector cell is a leukocyte. In some embodiments, the immune effector cell is a T cell. In some embodiments, the immune effector cell is a NK cell. In some embodiments, the immune effector cell is a mononuclear cell, such as a myeloid mononuclear cell. In some embodiments, the T-cell engaging multispecific antibodies and/or T-cell engaging multispecific activatable antibodies bind CD3ε.

In some embodiments, the immune effector cell engaging multispecific antibodies include a targeting antibody or antigen-binding fragment thereof and an immune effector cell engaging antibody or antigen-binding portion thereof that includes an anti-CD3ε antibody or antigen-binding fragment thereof. In some embodiments, the immune effector cell engaging multispecific antibodies include a cancer targeting antibody or antigen-binding fragment thereof and an immune effector cell engaging antibody or antigen-binding portion thereof. In some embodiments, the immune effector cell engaging multispecific antibodies include a cancer targeting IgG antibody or antigen-binding fragment thereof and an immune effector cell engaging scFv. In some embodiments, the immune effector cell is a leukocyte. In some embodiments, the immune effector cell is a T cell. In some embodiments, the immune effector cell is a NK cell. In some embodiments, the immune effector cell is a myeloid mononuclear cell.

In some embodiments, the T-cell engaging multispecific antibody includes an anti-CD3ε antibody or antigen-binding fragment thereof and a targeting antibody or antigen-binding fragment thereof. In some embodiments, the T-cell engaging multispecific antibody includes an anti-CD3εscFv and a targeting antibody or antigen-binding fragment thereof. In some embodiments, the T-cell engaging multispecific antibody includes an anti-CD3ε antibody or antigen-binding fragment thereof and a cancer-targeting antibody or antigen-binding fragment thereof. In some embodiments, the T-cell engaging multispecific antibody includes an anti-CD3εscFv and a cancer targeting antibody or antigen-binding fragment thereof. In some embodiments, the T-cell engaging multispecific antibody includes an anti-CD3ε antibody or antigen-binding fragment thereof and a cancer-targeting IgG antibody or antigen-binding fragment thereof. In some embodiments, the T-cell engaging multispecific antibody includes an anti-CD3εscFv and a cancer targeting IgG antibody or antigen-binding fragment thereof. In some embodiments, the T-cell engaging multispecific antibody includes an anti-CD3 epsilon (CD3ε) scFv that is derived from OKT3. In some embodiments, the T-cell engaging multispecific antibody includes an anti-CD3 epsilon (CD3ε) scFv that is derived from SP34 (available from BD Biosciences Cat#556610).

In some embodiments, the T-cell engaging multispecific activatable antibodies include a targeting antibody or antigen-binding fragment thereof and anti-CD3ε antibody or antigen-binding fragment thereof, where at least one of the targeting antibody or antigen-binding fragment thereof and/or the anti-CD3ε antibody or antigen-binding portion thereof is masked. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target.

In some embodiments, the T-cell engaging multispecific activatable antibodies include a cancer targeting antibody or antigen-binding fragment thereof and an anti-CD3ε antibody or antigen-binding portion thereof, where at least one of the cancer targeting antibody or antigen-binding fragment thereof and/or the anti-CD3ε antibody or antigen-binding portion thereof is masked. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibodies include a cancer targeting IgG antibody or antigen-binding fragment thereof and an anti-CD3ε, where at least one of the cancer targeting IgG antibody or antigen-binding fragment thereof and/or the anti-CD3ε antibody or antigen-binding portion thereof is masked. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the anti-CD3ε antibody or antigen binding fragment thereof includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an anti-CD3εscFv and a targeting antibody or antigen-binding fragment thereof, where at least one of the anti-CD3εscFv and/or the targeting antibody or antigen-binding portion thereof is masked. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target.

In some embodiments, the T-cell engaging multispecific activatable antibody includes an anti-CD3εscFv and a cancer targeting antibody or antigen-binding fragment thereof, where at least one of the anti-CD3εscFv and/or the cancer targeting antibody or antigen-binding portion thereof is masked. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an anti-CD3εscFv and a cancer targeting IgG antibody or antigen-binding fragment thereof, where at least one of the anti-CD3εscFv and/or the cancer targeting IgG antibody or antigen-binding portion thereof is masked. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the CD3εscFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody IgG or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an anti-CD3 epsilon (CD3ε) scFv that is derived from OKT3, where at least one of the targeting antibody or antigen-binding fragment thereof and/or the OKT3 scFv or OKT3-derived scFv is masked. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target.

In some embodiments, the T-cell engaging multispecific activatable antibody includes an OKT3 scFv or OKT3-derived scFv and a cancer targeting antibody or antigen-binding fragment thereof, where at least one of the OKT3 scFv or OKT3-derived scFv and/or the cancer targeting antibody or antigen-binding portion thereof is masked. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an OKT3 scFv or OKT3-derived scFv and a cancer targeting IgG antibody or antigen-binding fragment thereof, where at least one of the OKT3 scFv or OKT3-derived scFv and/or the cancer targeting IgG antibody or antigen-binding portion thereof is masked. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the OKT3 scFv or OKT3-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody IgG or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an anti-CD3 epsilon (CD3ε) scFv that is derived from SP34, where at least one of the targeting antibody or antigen-binding fragment thereof and/or the SP34 scFv or SP34-derived scFv is masked. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target.

In some embodiments, the T-cell engaging multispecific activatable antibody includes an SP34 scFv or SP34-derived scFv and a cancer targeting antibody or antigen-binding fragment thereof, where at least one of the SP34 scFv or SP34-derived scFv and/or the cancer targeting antibody or antigen-binding portion thereof is masked. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an SP34 scFv or SP34-derived scFv and a cancer targeting IgG antibody or antigen-binding fragment thereof, where at least one of the SP34 scFv or SP34-derived scFv and/or the cancer targeting IgG antibody or antigen-binding portion thereof is masked. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the SP34 scFv or SP34-derived scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the cancer targeting antibody IgG or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the T-cell engaging multispecific activatable antibody includes an anti-CD3 epsilon (CD3ε) scFv that includes the following complementarity determining region (CDR) sequences: a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58), where at least one of the targeting antibody or antigen-binding fragment thereof and/or the anti-CD3ε scFv is masked. In some embodiments, the anti-CD3ε scFv includes a first antibody or antigen-binding fragment thereof (AB1) having the CDR sequences set for the above, i.e., SEQ ID NOs: 53, 54, 55, 56, 57, and 58, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target. In some embodiments, the anti-CD3ε scFv includes a first antibody or antigen-binding fragment thereof (AB1) that includes the CDR sequences of SEQ ID NOs: 53, 54, 55, 56, 57, and 58, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds a second target, where the AB2 is attached to a masking moiety (MM2) such that coupling of the MM2 reduces the ability of the AB2 to bind the second target.

In some embodiments, the T-cell engaging multispecific activatable antibody includes an anti-CD3ε scFv that includes the CDR sequences of SEQ ID NOs: 53, 54, 55, 56, 57, and 58 and a cancer targeting antibody or antigen-binding fragment thereof, where at least one of the anti-CD3ε scFv and/or the cancer targeting antibody or antigen-binding portion thereof is masked. In some embodiments, the anti-CD3ε scFv includes a first antibody or antigen-binding fragment thereof (AB1) that includes the CDR sequences of SEQ ID NOs: 53, 54, 55, 56, 57, and 58, where the AB1 is attached to a masking moiety (MM1) such that coupling of the MM1 reduces the ability of the AB1 to bind CD3ε. In some embodiments, the cancer targeting antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the anti-CD3εd scFv that includes the CDR sequences of SEQ ID NOs: 53, 54, 55, 56, 57, and 58 and a cancer targeting IgG antibody or antigen-binding fragment thereof, where at least one of the anti-CD3ε scFv and/or the cancer targeting IgG antibody or antigen-binding portion thereof is masked. In some embodiments, the anti-CD3ε scFv includes a first antibody or antigen-binding fragment thereof (AB1) that includes the CDR sequences of SEQ ID NOs: 53, 54, 55, 56, 57, and 58, where the AB1 is attached to a masking moiety (MM1) such that coupling of the MM1 reduces the ability of the AB1 to bind CD3ε. In some embodiments, the cancer targeting IgG antibody or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target. In some embodiments, the anti-CD3ε scFv includes a first antibody or antigen-binding fragment thereof (AB1) that includes the CDR sequences of SEQ ID NOs: 53, 54, 55, 56, 57, and 58, where the AB1 is attached to a masking moiety (MM1) such that coupling of the MM1 reduces the ability of the AB1 to bind CD3ε, and the cancer targeting antibody IgG or antigen-binding fragment thereof includes a second antibody or fragment thereof that includes a second antibody or antigen-binding fragment thereof (AB2) that binds a second, cancer-related target, where the AB2 is attached to a masking moiety (MM2) such that coupling of the MM2 reduces the ability of the AB2 to bind the second, cancer-related target.

In some embodiments, the multi-antigen targeting antibodies and/or multi-antigen targeting activatable antibodies include at least a first antibody or antigen-binding fragment thereof that binds a first target and/or first epitope and a second antibody or antigen-binding fragment thereof that binds a second target and/or a second epitope, where at least one of the targets and/or epitopes is CD3ε. In some embodiments, the multi-antigen targeting antibodies and/or multi-antigen targeting activatable antibodies bind two or more different targets, where at least one target is CD3ε. In some embodiments, the multi-antigen targeting antibodies and/or multi-antigen targeting activatable antibodies bind two or more different epitopes on CD3ε. In some embodiments, the multi-antigen targeting antibodies and/or multi-antigen targeting activatable antibodies bind a combination of two or more different targets and two or more different epitopes on the same target, where at least one of the targets and/or epitopes is CD3ε.

Various embodiments of multispecific activatable antibodies of the disclosure are shown in FIGS. 5A-5D, 6A-6F, 7A-7J, 8A-8J, 9A-9J, 10A-10J, 11A-11J, and 12A-12D. In some embodiments, a multispecific activatable antibody comprising an IgG has the IgG variable domains masked. In some embodiments, a multispecific activatable antibody comprising a scFv has the scFv domains masked. In some embodiments, a multispecific activatable antibody has both IgG variable domains and scFv domains, where at least one of the IgG variable domains is coupled to a masking moiety. In some embodiments, a multispecific activatable antibody has both IgG variable domains and scFv domains, where at least one of the scFv domains is coupled to a masking moiety. In some embodiments, a multispecific activatable antibody has both IgG variable domains and scFv domains, where at least one of the IgG variable domains is coupled to a masking moiety and at least one of the scFv domains is coupled to a masking moiety. In some embodiments, a multispecific activatable antibody has both IgG variable domains and scFv domains, where each of the IgG variable domains and the scFv domains is coupled to its own masking moiety. In some embodiments, one antibody domain of a multispecific activatable antibody has specificity for a target antigen and another antibody domain has specificity for a T-cell surface antigen. In some embodiments, one antibody domain of a multispecific activatable antibody has specificity for a target antigen and another antibody domain has specificity for another target antigen. In some embodiments, one antibody domain of a multispecific activatable antibody has specificity for an epitope of a target antigen and another antibody domain has specificity for another epitope of the target antigen.

In a multispecific activatable antibody, a scFv can be fused to the carboxyl terminus of the heavy chain of an IgG activatable antibody, to the carboxyl terminus of the light chain of an IgG activatable antibody, or to the carboxyl termini of both the heavy and light chains of an IgG activatable antibody. In a multispecific activatable antibody, a scFv can be fused to the amino terminus of the heavy chain of an IgG activatable antibody, to the amino terminus of the light chain of an IgG activatable antibody, or to the amino termini of both the heavy and light chains of an IgG activatable antibody. In a multispecific activatable antibody, a scFv can be fused to any combination of one or more carboxyl termini and one or more amino termini of an IgG activatable antibody. In some embodiments, a masking moiety (MM) linked to a cleavable moiety (CM) is attached to and masks an antigen binding domain of the IgG. In some embodiments, a masking moiety (MM) linked to a cleavable moiety (CM) is attached to and masks an antigen binding domain of at least one scFv. In some embodiments, a masking moiety (MM) linked to a cleavable moiety (CM) is attached to and masks an antigen binding domain of an IgG and a masking moiety (MM) linked to a cleavable moiety (CM) is attached to and masks an antigen binding domain of at least one scFv.

In some embodiments, a single chain variable domain, specific for binding CD3ε is fused to the carboxyl terminus of a fully human IgG1 antibody (targeting antibody) that binds to a cell surface antigen. Fusion of the scFv can be to the carboxyl terminus of the heavy chain, to the carboxyl terminus of the light chain or to both chains. In some embodiments, a single chain variable domain, specific for binding CD3ε is fused to the amino terminus of a fully human IgG1 antibody (targeting antibody) that binds to a cell surface antigen. Fusion of the scFv can be to the amino terminus of the heavy chain, to the amino terminus of the light chain or to both chains. The fusions are constructed as a single genetic construct and expressed in cells in culture. The targeting antibody can be specific for binding to one or more tumor surface antigens, or any cell targeted for depletion. The scFv can be specific for the same or different antigens.

Other examples of multispecific activatable antibody structures include, but are not limited to, the following: (VL-CL)$_2$:(VH-CH1-CH2-CH3-L4-VH*-L3-VL*-L2-CM-L1-MM)$_2$; (VL-CL)$_2$:(VH-CH1-CH2-CH3-L4-VL*-L3-VH*-L2-CM-L1-MM)$_2$; (MM-L1-CM-L2-VL-CL)$_2$:(VH-CH1-CH2-CH3-L4-VH*-L3-VL*)$_2$; (MM-L1-CM-L2-VL-CL)$_2$:(VH-CH1-CH2-CH3-L4-VL*-L3-VH*)$_2$; (VL-CL)$_2$:(MM-L1-CM-L2-VL*-L3-VH*-L4-VH-CH1-CH2-CH3)$_2$; (VL-CL)$_2$:(MM-L1-CM-L2-VH*-L3-VL*-L4-VH-CH1-CH2-CH3)$_2$; (MM-L1-CM-L2-VL-CL)$_2$:(VL*-L3-VH*-L4-VH-CH1-CH2-CH3)$_2$; (MM-L1-CM-L2-VL-CL)$_2$:(VH*-L3-VL*-L4-VH-CH1-CH2-CH3)$_2$; (VL-CL-L4-VH*-L3-VL*-L2-CM-L1-MM)$_2$:(VH-CH1-CH2-CH3)$_2$; (VL-CL-L4-VL*-L3-VH*-L2-CM-L1-MM)$_2$:(VH-CH1-CH2-CH3)$_2$; (MM-L1-CM-L2-VL*-L3-VH*-L4-VL-CL)$_2$:(VH-CH1-CH2-CH3)$_2$; (MM-L1-CM-L2-VH*-L3-VL*-L4-VL-CL)$_2$:(VH-CH1-CH2-CH3)$_2$; (VL-CL-L4-VH*-L3-VL*-L2-CM-L1-MM)$_2$: (MM-L1-CM-L2-VL*-L3-VH*-L4-VH-CH1-CH2-CH3)$_2$; (VL-CL-L4-VH*-L3-VL*-L2-CM-L1-MM)$_2$: (MM-L1-CM-L2-VH*-L3-VL*-L4-VH-CH1-CH2-CH3)$_2$; (VL-CL-L4-VL*-L3-VH*-L2-CM-L1-MM)$_2$: (MM-L1-CM-L2-VL*-L3-VH*-L4-VH-CH1-CH2-CH3)$_2$; (VL-CL-L4-VL*-L3-VH*-L2-CM-L1-MM)$_2$: (MM-L1-CM-L2-VH*-L3-VL*-L4-VH-CH1-CH2-CH3)$_2$; (VL-CL-L4-VH*-L3-VL*)$_2$: (MM-L1-CM-L2-VL*-L3-VH*-L4-VH-CH1-CH2-CH3)$_2$; (VL-CL-L4-VH*-L3-VL*)$_2$: (MM-L1-CM-L2-VH*-L3-VL*-L4-VH-CH1-CH2-CH3)$_2$; (VL-CL-L4-VL*-L3-VH*)$_2$: (MM-L1-CM-L2-VL*-L3-VH*-L4-VH-CH1-CH2-CH3)$_2$; (VL-CL-L4-VL*-L3-VH*)$_2$: (MM-L1-CM-L2-VH*-L3-VL*-L4-VH-CH1-CH2-CH3)$_2$; (VL-CL-L4-VH*-L3-VL*-L2-CM-L1-MM)$_2$: (VL*-L3-VH*-L4-VH-CH1-CH2-CH3)$_2$; (VL-CL-L4-VH*-L3-VL*-L2-CM-L1-MM)$_2$: (VH*-L3-VL*-L4-VH-CH1-CH2-CH3)$_2$; (VL-CL-L4-VL*-L3-VH*-L2-CM-L1-MM)$_2$: (VL*-L3-VH*-L4-VH-CH1-CH2-CH3)$_2$; or (VL-CL-L4-VL*-L3-VH*-L2-CM-L1-MM)$_2$: (VH*-L3-VL*-L4-VH-CH1-CH2-CH3)$_2$, wherein: VL and VH represent the light and heavy variable domains of the first specificity, contained in the IgG; VL* and VH* represent the variable domains of the second specificity, contained in the scFv; L1 is a linker peptide connecting the masking moiety (MM) and the cleavable moiety (CM); L2 is a linker peptide connecting the cleavable moiety (CM), and the antibody; L3 is a linker peptide connecting the variable domains of the scFv; L4 is a linker peptide connecting the antibody of the first specificity to the antibody of the second specificity; CL is the light-chain constant domain; and CH1, CH2, CH3 are the heavy chain constant domains. The first and second specificities may be toward any antigen or epitope.

In some embodiments of a T-cell engaging multispecific activatable antibody, one antigen is typically CD3ε and the other is an antigen present on the surface of a tumor cell or other cell type associated with disease, such as, but not limited to, any target listed in Table 1, such as, but not limited to, EGFR, erbB2, EpCAM, Jagged, PD-L1, B7H3, or CD71 (transferrin receptor).

In some embodiments, the targeting antibody includes an anti-EGFR antibody. In some embodiments, the targeting antibody includes C225v5, which is specific for binding to EGFR. In some embodiments, the targeting antibody includes C225, which is specific for binding to EGFR. In some embodiments, the targeting antibody includes C225v4, which is specific for binding to EGFR. In some embodiments, the targeting antibody includes C225v6, which is specific for binding to EGFR. In some embodiments, the targeting antibody includes an anti-Jagged antibody. In some embodiments, the targeting antibody includes 4D11, which is specific for binding to human and mouse Jagged 1 and Jagged 2. In some embodiments, the targeting antibody includes 4D11v2, which is specific for binding to human and mouse Jagged 1 and Jagged 2.

In some embodiments, the targeting antibody can be in the form an activatable antibody. In some embodiments, the scFv(s) can be in the form of a Pro-scFv (see, e.g., WO 2009/025846, WO 2010/081173).

In some embodiments, the multispecific antibodies and/or multispecific activatable antibodies provided herein include at least a first antibody or antigen binding fragment thereof (AB1) that specifically binds CD3ε and that contains a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), and combinations thereof.

In some embodiments, the multispecific antibodies and/or multispecific activatable antibodies provided herein include at least a first antibody or antigen binding fragment thereof (AB1) that specifically binds CD3ε and that contains a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58), and combinations thereof.

In some embodiments, the multispecific antibodies and/or multispecific activatable antibodies provided herein include at least a first antibody or antigen binding fragment thereof (AB1) that specifically binds CD3ε and that contains a VH CDR1 sequence that includes at least the amino acid sequence TYAMN (SEQ ID NO: 53); a VH CDR2 sequence that includes at least the amino acid sequence RIRSKYNNYATYYADSVKD (SEQ ID NO: 54); a VH CDR3 sequence that includes at least the amino acid sequence HGNFGNSYVSWFAY (SEQ ID NO: 55), a VL CDR1 sequence that includes at least the amino acid sequence RSSTGAVTTSNYAN (SEQ ID NO: 56); a VL CDR2 sequence that includes at least the amino acid sequence GTNKRAP (SEQ ID NO: 57); and a VL CDR3 sequence that includes at least the amino acid sequence ALWYSNLWV (SEQ ID NO: 58).

In some embodiments, the multispecific antibodies and/or multispecific activatable antibodies provided herein include at least a first antibody or antigen binding fragment thereof (AB1) that specifically binds CD3ε and that contains a VH CDR1 sequence that is at least 90%, 91%, 92%, 93%, 94%, 95%, 96%, 97%, 98%, 99% or more identical to the amino acid sequence TYAMN (SEQ ID NO: 53); a VH CDR2 sequence that is at least 90%, 91%, 92%, 93%, 94%, 95%, 96%, 97%, 98%, 99% or more identical to the amino acid sequence RIRSKYNNYATYYADSVKD (SEQ ID NO: 54); a VH CDR3 sequence that is at least 90%, 91%, 92%, 93%, 94%, 95%, 96%, 97%, 98%, 99% or more identical to the amino acid sequence HGNFGNSYVSWFAY (SEQ ID NO: 55), a VL CDR1 sequence that is at least 90%, 91%, 92%, 93%, 94%, 95%, 96%, 97%, 98%, 99% or more identical to the amino acid sequence RSSTGAVTTSNYAN (SEQ ID NO: 56); a VL CDR2 sequence that is at least 90%, 91%, 92%, 93%, 94%, 95%, 96%, 97%, 98%, 99% or more identical to the amino acid sequence GTNKRAP (SEQ ID NO: 57); and a VL CDR3 sequence that is at least 90%, 91%, 92%, 93%, 94%, 95%, 96%, 97%, 98%, 99% or more identical to the amino acid sequence ALWYSNLWV (SEQ ID NO: 58).

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence SYAMS (SEQ ID NO: 88); a VH CDR2 sequence that includes at least the amino acid sequence SIDPEGRQTYYADSVKG (SEQ ID NO: 89); and a VH CDR3 sequence that includes at least the amino acid sequence DIGGRSAFDY (SEQ ID NO: 90), and combinations thereof.

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RASQSISSY (SEQ ID NO: 91); a VL CDR2 sequence that includes at least the amino acid sequence AASSLQS (SEQ ID NO: 92); and a VL CDR3 sequence that includes at least the amino acid sequence QQTVVAPPL (SEQ ID NO: 93), and combinations thereof.

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence SYAMS (SEQ ID NO: 88); a VH CDR2 sequence that includes a sequence that is at least 90%, 91%, 92%, 93%, 94%, 95%, 96%, 97%, 98%, 99% or more identical to the amino acid sequence SIDPEGRQTYYADSVKG (SEQ ID NO: 89); and a VH CDR3 sequence that includes a sequence that is at least 90%, 91%, 92%, 93%, 94%, 95%, 96%, 97%, 98%, 99% or more identical to the amino acid sequence DIGGRSAFDY (SEQ ID NO: 90), and combinations thereof.

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RASQSISSY (SEQ ID NO: 91); a VL CDR2 sequence that includes a sequence that is at least 90%, 91%, 92%, 93%, 94%, 95%, 96%, 97%, 98%, 99% or more identical to the amino acid sequence AASSLQS (SEQ ID NO: 92); and a VL CDR3 sequence that includes a sequence that is at least 90%, 91%, 92%, 93%, 94%, 95%, 96%, 97%, 98%, 99% or more identical to the amino acid sequence QQTVVAPPL (SEQ ID NO: 93), and combinations thereof.

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence includes at least the amino acid sequence SYAMS (SEQ ID NO: 88); the VH CDR2 sequence includes at least the amino acid sequence SIDPEGRQTYYADSVKG (SEQ ID NO: 89); the VH CDR3 sequence includes at least the amino acid sequence DIGGRSAFDY (SEQ ID NO: 90); the VL CDR1 sequence includes at least the amino acid sequence RASQSISSY (SEQ ID NO: 91); the VL CDR2 sequence includes at least the amino acid sequence AASSLQS (SEQ ID NO: 92); and the VL CDR3 sequence includes at least the amino acid sequence QQTVVAPPL (SEQ ID NO: 93).

In some embodiments, the multispecific antibodies and/or multispecific activatable antibodies provided herein include at least a first antibody or antigen binding fragment thereof (AB1) that specifically binds a Jagged target, e.g., Jagged 1 and/or Jagged 2, and that contains a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence includes a sequence that is at least 90%, 91%, 92%, 93%, 94%, 95%, 96%, 97%, 98%, 99% or more identical to the amino acid sequence SYAMS (SEQ ID NO: 88); the VH CDR2 sequence includes a sequence that is at least 90%, 91%, 92%, 93%, 94%, 95%, 96%, 97%, 98%, 99% or more identical to the amino acid sequence SIDPEGRQTYYADSVKG (SEQ ID NO: 89); the VH CDR3 sequence includes a sequence that is at least 90%, 91%, 92%, 93%, 94%, 95%, 96%, 97%, 98%, 99% or more identical to the amino acid sequence DIGGRSAFDY (SEQ ID NO: 90); the VL CDR1 sequence includes a sequence that is at least 90%, 91%, 92%, 93%, 94%, 95%, 96%, 97%, 98%, 99% or more identical to the amino acid sequence RASQSISSY (SEQ ID NO: 91); the VL CDR2 sequence includes a sequence that is at least 90%, 91%, 92%, 93%, 94%, 95%, 96%, 97%, 98%, 99% or more identical to the amino acid sequence AASSLQS (SEQ ID NO: 92); and the VL CDR3 sequence includes a sequence that is at least 90%, 91%, 92%, 93%, 94%, 95%, 96%, 97%, 98%, 99% or more identical to the amino acid sequence QQTVVAPPL (SEQ ID NO: 93).

In some embodiments, the multispecific antibodies and/or multispecific activatable antibodies provided herein include at least a first antibody or antigen binding fragment thereof (AB1) that specifically binds Epidermal Growth Factor Receptor (EGFR) and that contains a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes at least the amino acid sequence NYGVH (SEQ ID NO: 94); a VH CDR2 sequence that includes at least the amino acid sequence VIWSGGNTDYNTPFTS (SEQ ID NO: 95); a VH CDR3 sequence that includes at least the amino acid sequence ALTYYDYEFAY (SEQ ID NO: 96); and combinations thereof.

In some embodiments, the multispecific antibodies and/or multispecific activatable antibodies provided herein include at least a first antibody or antigen binding fragment thereof (AB1) that specifically binds EGFR and that contains a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes at least the amino acid sequence RASQSIGTNIH (SEQ ID NO: 97); a VL CDR2 sequence that includes at least the amino acid sequence KYASESIS (SEQ ID NO: 98); and a VL CDR3 sequence that includes at least the amino acid sequence QQNNNWPTT (SEQ ID NO: 99), and combinations thereof.

In some embodiments, the multispecific antibodies and/or multispecific activatable antibodies provided herein include at least a first antibody or antigen binding fragment thereof (AB1) that specifically binds EGFR and that contains a combination of a VH CDR1 sequence, a VH CDR2 sequence, and a VH CDR3 sequence, wherein at least one of the VH CDR1 sequence, the VH CDR2 sequence, and the VH CDR3 sequence is selected from a VH CDR1 sequence that includes a sequence that is at least 90%, 91%, 92%, 93%, 94%, 95%, 96%, 97%, 98%, 99% or more identical to the amino acid sequence NYGVH (SEQ ID NO: 94); a VH CDR2 sequence that includes a sequence that is at least 90%, 91%, 92%, 93%, 94%, 95%, 96%, 97%, 98%, 99% or more identical to the amino acid sequence VIWSGGNTDYNTPFTS (SEQ ID NO: 95); a VH CDR3 sequence that includes a sequence that is at least 90%, 91%, 92%, 93%, 94%, 95%, 96%, 97%, 98%, 99% or more identical to the amino acid sequence ALTYYDYEFAY (SEQ ID NO: 96); and combinations thereof.

In some embodiments, the multispecific antibodies and/or multispecific activatable antibodies provided herein include at least a first antibody or antigen binding fragment thereof (AB1) that specifically binds EGFR and that contains a combination of a VL CDR1 sequence, a VL CDR2 sequence, and a VL CDR3 sequence, wherein at least one of the VL CDR1 sequence, the VL CDR2 sequence, and the VL CDR3 sequence is selected from a VL CDR1 sequence that includes a sequence that is at least 90%, 91%, 92%, 93%, 94%, 95%, 96%, 97%, 98%, 99% or more identical to the amino acid sequence RASQSIGTNIH (SEQ ID NO: 97); a VL CDR2 sequence that includes a sequence that is at least 90%, 91%, 92%, 93%, 94%, 95%, 96%, 97%, 98%, 99% or more identical to the amino acid sequence KYASESIS (SEQ ID NO: 98); and a VL CDR3 sequence that includes a sequence that is at least 90%, 91%, 92%, 93%, 94%, 95%, 96%, 97%, 98%, 99% or more identical to the amino acid sequence QQNNNWPTT (SEQ ID NO: 99), and combinations thereof.

In some embodiments, the multispecific antibodies and/or multispecific activatable antibodies provided herein include at least a first antibody or antigen binding fragment thereof (AB1) that specifically binds EGFR and that contains a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence includes at least the amino acid sequence NYGVH (SEQ ID NO: 94); the VH CDR2 sequence includes at least the amino acid sequence VIWSGGNTDYNTPFTS (SEQ ID NO: 95); the VH CDR3 sequence includes at least the amino acid sequence ALTYYDYEFAY (SEQ ID NO: 96); the VL CDR1 sequence includes at least the amino acid sequence RASQSIGTNIH (SEQ ID NO: 97); the VL CDR2 sequence includes at least the amino acid sequence KYASESIS (SEQ ID NO: 98); and the VL CDR3 sequence includes at least the amino acid sequence QQNNNWPTT (SEQ ID NO: 99).

In some embodiments, the multispecific antibodies and/or multispecific activatable antibodies provided herein include at least a first antibody or antigen binding fragment thereof (AB1) that specifically binds EGFR and that contains a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence includes a sequence that is at least 90%, 91%, 92%, 93%, 94%, 95%, 96%, 97%, 98%, 99% or more identical to the amino acid sequence NYGVH (SEQ ID NO: 94); the VH CDR2 sequence includes a sequence that is at least 90%, 91%, 92%, 93%, 94%, 95%, 96%, 97%, 98%, 99% or more identical to the amino acid sequence VIWSGGNTDYNTPFTS (SEQ ID NO: 95); the VH CDR3 sequence includes a sequence that is at least 90%, 91%, 92%, 93%, 94%, 95%, 96%, 97%, 98%, 99% or more identical to the amino acid sequence ALTYYDYEFAY (SEQ ID NO: 96); the VL CDR1 sequence includes a sequence that is at least 90%, 91%, 92%, 93%, 94%, 95%, 96%, 97%, 98%, 99% or more identical to the amino acid sequence RASQSIGTNIH (SEQ ID NO: 97); the VL CDR2 sequence includes a sequence that is at least 90%, 91%, 92%, 93%, 94%, 95%, 96%, 97%, 98%, 99% or more identical to the amino acid sequence KYASESIS (SEQ ID NO: 98); and the VL CDR3 sequence includes a sequence that is at least 90%, 91%, 92%, 93%, 94%, 95%, 96%, 97%, 98%, 99% or more identical to the amino acid sequence QQNNNWPTT (SEQ ID NO: 99).

In some embodiments, the multispecific antibodies and/or multispecific activatable antibodies provided herein include at least a heavy chain amino acid sequence selected from the group consisting of those sequences shown in the Examples provided herein. In some embodiments, the multispecific antibodies and/or multispecific activatable antibodies provided herein include at least a light chain amino acid sequence selected from the group consisting of those sequences shown in the Examples provided herein. In some embodiments, the multispecific antibodies and/or multispecific activatable antibodies provided herein include at least a heavy chain amino acid sequence selected from the group consisting of those sequences shown in the Examples provided herein, and a light chain amino acid sequence selected from the group consisting of those sequences shown in the Examples provided herein.

In some embodiments, the multispecific antibodies and/or multispecific activatable antibodies provided herein include at least a heavy chain amino acid sequence that is at least 90%, 91%, 92%, 93%, 94%, 95%, 96%, 97%, 98%, 99% or more identical to an amino acid sequence selected from the group consisting of those sequences shown in the Examples provided herein. In some embodiments, the multispecific antibodies and/or multispecific activatable antibodies provided herein include at least a light chain amino acid sequence that is at least 90%, 91%, 92%, 93%, 94%, 95%, 96%, 97%, 98%, 99% or more identical to an amino acid sequence selected from the group consisting of those sequences shown in the Examples provided herein. In some embodiments, the multispecific antibodies and/or multispecific activatable antibodies provided herein include at least a heavy chain amino acid sequence that is at least 90%, 91%, 92%, 93%, 94%, 95%, 96%, 97%, 98%, 99% or more identical to an amino acid sequence selected from the group consisting of those sequences shown in the Examples provided herein, and a light chain amino acid sequence that is at least 90%, 91%, 92%, 93%, 94%, 95%, 96%, 97%, 98%, 99% or more identical to an amino acid sequence selected from the group consisting of those sequences shown in the Examples provided herein.

In some embodiments, the multispecific antibody and/or multispecific activatable antibody also includes an agent conjugated to the AB. In some embodiments, the agent is a therapeutic agent. In some embodiments, the agent is a detectable moiety. In some embodiments, the detectable moiety is a diagnostic agent. In some embodiments, the agent is conjugated to the multispecific via a linker. In some embodiments, the linker is a cleavable linker. In some embodiments, the linker is a non-cleavable linker.

In some embodiments, the multispecific antibody and/or multispecific activatable antibody also includes a detectable moiety. In some embodiments, the detectable moiety is a diagnostic agent.

In some embodiments, the multispecific antibody and/or multispecific activatable antibody naturally contains one or more disulfide bonds. In some embodiments, the multispecific antibody and/or multispecific activatable antibody can be engineered to include one or more disulfide bonds.

The disclosure also provides an isolated nucleic acid molecule encoding at least a portion of a multispecific antibody and/or multispecific activatable antibody described herein, such as for example, at least a first nucleic acid encoding at least a portion of the heavy chain of the multispecific antibody and/or multispecific activatable antibody and a second nucleic acid encoding at least a portion of the light chain of the multispecific antibody and/or multispecific activatable antibody, as well as vectors that include these isolated nucleic acid sequences. The disclosure provides methods of producing a multispecific antibody by culturing a cell under conditions that lead to expression of the antibody, wherein the cell comprises such a nucleic acid molecule(s). In some embodiments, the cell comprises such a vector.

The disclosure also provides multispecific activatable antibodies and/or multispecific activatable antibody compositions that include at least a first antibody or antigen-binding fragment thereof (AB1) that specifically binds a first target or first epitope and a second antibody or antigen-biding fragment thereof (AB2) that binds a second target or a second epitope, where at least AB1 is coupled or otherwise attached to a masking moiety (MM1), such that coupling of the MM1 reduces the ability of AB1 to bind its target. In some embodiments, the MM1 is coupled to AB1 via a first cleavable moiety (CM1) sequence that includes a substrate for a protease, for example, a protease that is produced by a tumor that is in proximity to cells that express the target and/or produced by a tumor that is co-localized with the target of AB1 at a treatment site or a diagnostic site in a subject. The multispecific activatable antibodies provided herein are stable in circulation, activated at intended sites of therapy and/or diagnosis but not in normal, i.e., healthy tissue, and, when activated, exhibit binding to the target of AB1 that is at least comparable to the corresponding, unmodified multispecific antibody.

In some embodiments, the multispecific activatable antibody comprises a linking peptide between the MM1 and the CM1.

In some embodiments, the multispecific activatable antibody comprises a linking peptide between the CM1 and the AB1.

In some embodiments, the activatable antibody comprises a first linking peptide (LP1) and a second linking peptide (LP2), and at least a portion of the multispecific activatable antibody in the uncleaved state has the structural arrangement from N-terminus to C-terminus as follows: MM1-LP1-CM1-LP2-AB1 or AB1-LP2-CM1-LP1-MM1. In some embodiments, the two linking peptides need not be identical to each other.

In some embodiments, at least one of LP1 or LP2 includes an amino acid sequence selected from the group consisting of $(GS)_n$, $(GGS)_n$, $(GSGGS)_n$ (SEQ ID NO: 59) and $(GGGS)_n$ (SEQ ID NO: 60), where n is an integer of at least one. In some embodiments, at least one of LP1 or LP2 includes an amino acid sequence selected from the group consisting of GGSG (SEQ ID NO: 61), GGSGG (SEQ ID NO: 62), GSGSG (SEQ ID NO: 63), GSGGG (SEQ ID NO: 64), GGGSG (SEQ ID NO: 65), and GSSSG (SEQ ID NO: 66).

In some embodiments, the multispecific activatable antibody includes at least a first antibody or antigen-binding fragment thereof (AB1) that specifically binds a first target or first epitope and a second antibody or antigen-binding fragment thereof (AB2) that specifically binds a second target or second epitope. In some embodiments, each of the AB in the multispecific activatable antibody is independently selected from the group consisting of a monoclonal antibody, domain antibody, single chain, Fab fragment, a F(ab')$_2$ fragment, a scFv, a scAb, a dAb, a single domain heavy chain antibody, and a single domain light chain antibody. In some embodiments, each of the AB in the multispecific activatable antibody is a rodent (e.g., mouse or rat), chimeric, humanized or fully human monoclonal antibody.

In some embodiments, each of the AB in the multispecific activatable antibody has a dissociation constant of about 100 nM or less for binding to its corresponding target or epitope.

In some embodiments, the MM1 has a dissociation constant, i.e., dissociation constant at an equilibrium state, $K_d$ for binding to the AB that is greater than the $K_d$ for binding of the AB to its corresponding target or epitope.

In some embodiments, the MM1 has a $K_d$ for binding to the AB that is no more than the $K_d$ for binding of the AB to its corresponding target or epitope.

In some embodiments, the MM1 has a $K_d$ for binding to the AB that is no less than the $K_d$ for binding of the AB to its corresponding target or epitope.

In some embodiments, the MM1 has a $K_d$ for binding to the AB that is approximately equal to the $K_d$ for binding of the AB to its corresponding target or epitope.

In some embodiments, the MM1 has a $K_d$ for binding to the AB that is less than the $K_d$ for binding of the AB to its corresponding target or epitope.

In some embodiments, the MM1 has a $K_d$ for binding to the AB that is no more than 2, 3, 4, 5, 10, 25, 50, 100, 250, 500, or 1,000 fold greater than the $K_d$ for binding of the AB to its corresponding target or epitope. In some embodiments, the MM1 has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to its corresponding target or epitope.

In some embodiments, the MM1 has an affinity for binding to the AB that is less than the affinity of binding of the AB to its corresponding target or epitope.

In some embodiments, the MM1 has an affinity for binding to the AB that is no more than the affinity of binding of the AB to its corresponding target or epitope.

In some embodiments, the MM1 has an affinity for binding to the AB that is approximately equal of the affinity of binding of the AB to its corresponding target or epitope.

In some embodiments, the MM1 has an affinity for binding to the AB that is no less than the affinity of binding of the AB to its corresponding target or epitope.

In some embodiments, the MM1 has an affinity for binding to the AB that is greater than the affinity of binding of the AB to its corresponding target or epitope.

In some embodiments, the MM1 has an affinity for binding to the AB that is 2, 3, 4, 5, 10, 25, 50, 100, 250, 500, or 1,000 less than the affinity of binding of the AB to its corresponding target or epitope. In some embodiments, the MM1 has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to its corresponding target or epitope. In some embodiments, the MM1 has an affinity for binding to the AB that is 2 to 20 fold less than the affinity of binding of the AB to its corresponding target or epitope. In some embodiments, a MM not covalently linked to the AB and at equimolar concentration to the AB does not inhibit the binding of the AB to its corresponding target or epitope.

In some embodiments, MM1 does not interfere or compete with its corresponding AB for binding to the corresponding target or epitope when the multispecific activatable antibody is in a cleaved state.

In some embodiments, MM1 is a polypeptide of about 2 to 40 amino acids in length. In some embodiments, each of the MM in the multispecific activatable antibody is a polypeptide of no more than 40 amino acids in length.

In some embodiments, MM1 has a polypeptide sequence that is different from that of target of the corresponding AB.

In some embodiments, MM1 has a polypeptide sequence that is no more than 50% identical to any natural binding partner of the corresponding AB. In some embodiments, MM1 has a polypeptide sequence that is no more than 25% identical to any natural binding partner of the corresponding AB. In some embodiments, MM1 has a polypeptide sequence that is no more than 10% identical to any natural binding partner of the corresponding AB.

In some embodiments, the coupling of MM1 reduces the ability of the corresponding AB to bind its target or epitope such that the dissociation constant ($K_d$) of the AB when coupled to the MM1 towards its corresponding target or epitope is at least 20 times greater than the $K_d$ of the AB when not coupled to the MM1 towards its corresponding target or epitope.

In some embodiments, the coupling of MM1 reduces the ability of the corresponding AB to bind its target or epitope such that the dissociation constant ($K_d$) of the AB when coupled to the MM1 towards its corresponding target or epitope is at least 40 times greater than the $K_d$ of the AB when not coupled to the MM1 towards its corresponding target or epitope.

In some embodiments, the coupling of MM1 reduces the ability of the corresponding AB to bind its target or epitope such that the dissociation constant ($K_d$) of the AB when coupled to the MM1 towards its corresponding target or epitope is at least 100 times greater than the $K_d$ of the AB when not coupled to the MM1 towards its corresponding target or epitope.

In some embodiments, the coupling of MM1 reduces the ability of the corresponding AB to bind its target or epitope such that the dissociation constant ($K_d$) of the AB when coupled to the MM1 towards its corresponding target or epitope is at least 1000 times greater than the $K_d$ of the AB when not coupled to the MM1 towards its corresponding target or epitope.

In some embodiments, the coupling of MM1 reduces the ability of the corresponding AB to bind its target or epitope such that the dissociation constant ($K_d$) of the AB when coupled to the MM1 towards its corresponding target or epitope is at least 10,000 times greater than the $K_d$ of the AB when not coupled to the MM1 towards its corresponding target or epitope.

In some embodiments, MM1 is an amino acid sequence selected from a MM shown in the Examples provided herein.

In some embodiments, the multispecific activatable antibody includes at least a second masking moiety (MM2) that inhibits the binding of the AB2 to its target when the multispecific activatable antibody is in an uncleaved state, and a second cleavable moiety (CM2) coupled to the AB2, wherein the CM2 is a polypeptide that functions as a substrate for a second protease. In some embodiments, CM2 is a polypeptide of no more than 15 amino acids long. In some embodiments, the second protease is produced by a tumor that is in proximity to cells that express the target and/or produced by a tumor that is co-localized with the second target or epitope in a tissue, and wherein the second protease cleaves the CM2 in the multispecific activatable antibody when the multispecific activatable antibody is exposed to the second protease. In some embodiments, the first protease and the second protease are produced by a tumor that is in proximity to cells that express the target and/or produced by a tumor that is co-localized with the first target or epitope and the second target or epitope in a tissue. In some embodiments, the first protease and the second protease are the same protease. In some embodiments, CM1 and CM2 are different substrates for the same protease. In some embodiments, the protease is selected from the group consisting of those shown in Table 3. In some embodiments, the first protease and the second protease are different proteases. In some embodiments, the first protease and the second protease are different proteases selected from the group consisting of those shown in Table 3.

In some embodiments, each of the MM in the multispecific activatable antibody has a dissociation constant, i.e., dissociation constant at an equilibrium state, $K_d$ for binding to the AB that is greater than the $K_d$ for binding of the AB to its corresponding target or epitope.

In some embodiments, each of the MM in the multispecific activatable antibody has a $K_d$ for binding to the AB that is no more than the $K_d$ for binding of the AB to its corresponding target or epitope.

In some embodiments, each of the MM in the multispecific activatable antibody has a $K_d$ for binding to the AB that is no less than the $K_d$ for binding of the AB to its corresponding target or epitope.

In some embodiments, each of the MM in the multispecific activatable antibody has a $K_d$ for binding to the AB that is approximately equal to the $K_d$ for binding of the AB to its corresponding target or epitope.

In some embodiments, each of the MM in the multispecific activatable antibody has a $K_d$ for binding to the AB that is less than the $K_d$ for binding of the AB to its corresponding target or epitope.

In some embodiments, each of the MM in the multispecific activatable antibody has a $K_d$ for binding to the AB that is no more than 2, 3, 4, 5, 10, 25, 50, 100, 250, 500, or 1,000 fold greater than the $K_d$ for binding of the AB to its corresponding target or epitope. In some embodiments, each of the MM in the multispecific activatable antibody has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to its corresponding target or epitope.

In some embodiments, each of the MM in the multispecific activatable antibody has an affinity for binding to the AB that is less than the affinity of binding of the AB to its corresponding target or epitope.

In some embodiments, each of the MM in the multispecific activatable antibody has an affinity for binding to the AB that is no more than the affinity of binding of the AB to its corresponding target or epitope.

In some embodiments, each of the MM in the multispecific activatable antibody has an affinity for binding to the AB that is approximately equal of the affinity of binding of the AB to its corresponding target or epitope.

In some embodiments, each of the MM in the multispecific activatable antibody has an affinity for binding to the AB that is no less than the affinity of binding of the AB to its corresponding target or epitope.

In some embodiments, each of the MM in the multispecific activatable antibody has an affinity for binding to the AB that is greater than the affinity of binding of the AB to its corresponding target or epitope.

In some embodiments, each of the MM in the multispecific activatable antibody has an affinity for binding to the AB that is 2, 3, 4, 5, 10, 25, 50, 100, 250, 500, or 1,000 less than the affinity of binding of the AB to its corresponding target or epitope. In some embodiments, each of the MM in the multispecific activatable antibody has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to its corresponding target or epitope. In some embodiments, each of the MM in the multispecific activatable antibody has an affinity for binding to the AB that is 2 to 20 fold less than the affinity of binding of the AB to its corresponding target or epitope. In some embodiments, a MM not covalently linked to the AB and at equimolar concentration to the AB does not inhibit the binding of the AB to its corresponding target or epitope.

In some embodiments, each of the MM in the multispecific activatable antibody does not interfere or compete with its corresponding AB for binding to the corresponding target or epitope when the multispecific activatable antibody is in a cleaved state.

In some embodiments, each of the MM in the multispecific activatable antibody is a polypeptide of about 2 to 40 amino acids in length. In some embodiments, each of the MM in the multispecific activatable antibody is a polypeptide of no more than 40 amino acids in length.

In some embodiments, each of the MM in the multispecific activatable antibody has a polypeptide sequence that is different from that of target of the corresponding AB.

In some embodiments, each of the MM in the multispecific activatable antibody has a polypeptide sequence that is no more than 50% identical to any natural binding partner of the corresponding AB. In some embodiments, each of the MM in the multispecific activatable antibody has a polypeptide sequence that is no more than 25% identical to any natural binding partner of the corresponding AB. In some embodiments, each of the MM in the multispecific activatable antibody has a polypeptide sequence that is no more than 10% identical to any natural binding partner of the corresponding AB.

In some embodiments, the coupling of each of the MM reduces the ability of the corresponding AB to bind its target or epitope such that the dissociation constant ($K_d$) of the AB when coupled to the MM towards its corresponding target or epitope is at least 20 times greater than the $K_d$ of the AB when not coupled to the MM towards its corresponding target or epitope.

In some embodiments, the coupling of each of the MM reduces the ability of the corresponding AB to bind its target or epitope such that the dissociation constant ($K_d$) of the AB when coupled to the MM towards its corresponding target or epitope is at least 40 times greater than the $K_d$ of the AB when not coupled to the MM towards its corresponding target or epitope.

In some embodiments, the coupling of each of the MM reduces the ability of the corresponding AB to bind its target or epitope such that the dissociation constant ($K_d$) of the AB when coupled to the MM towards its corresponding target or epitope is at least 100 times greater than the $K_d$ of the AB when not coupled to the MM towards its corresponding target or epitope.

In some embodiments, the coupling of each of the MM reduces the ability of the corresponding AB to bind its target or epitope such that the dissociation constant ($K_d$) of the AB when coupled to the MM towards its corresponding target or epitope is at least 1000 times greater than the $K_d$ of the AB when not coupled to the MM towards its corresponding target or epitope.

In some embodiments, the coupling of each of the MM reduces the ability of the corresponding AB to bind its target or epitope such that the dissociation constant ($K_d$) of the AB when coupled to the MM towards its corresponding target or epitope is at least 10,000 times greater than the $K_d$ of the AB when not coupled to the MM towards its corresponding target or epitope.

In some embodiments, the coupling of each of the MM reduces the ability of the corresponding AB to bind its target or epitope such that the dissociation constant ($K_d$) of the AB1 when coupled to the MM1 is at least 20 times greater than the $K_d$ of the AB2 when coupled to the MM2. In some embodiments, the coupling of each of the MM reduces the ability of the corresponding AB to bind its target or epitope such that the dissociation constant ($K_d$) of the AB1 when coupled to the MM1 is at least 20 times lower than the $K_d$ of the AB2 when coupled to the MM2.

In some embodiments, the coupling of each of the MM reduces the ability of the corresponding AB to bind its target or epitope such that the dissociation constant ($K_d$) of the AB1 when coupled to the MM1 is at least 40 times greater than the $K_d$ of the AB2 when coupled to the MM2. In some embodiments, the coupling of each of the MM reduces the ability of the corresponding AB to bind its target or epitope such that the dissociation constant ($K_d$) of the AB1 when coupled to the MM1 is at least 40 times lower than the $K_d$ of the AB2 when coupled to the MM2.

In some embodiments, the coupling of each of the MM reduces the ability of the corresponding AB to bind its target or epitope such that the dissociation constant ($K_d$) of the AB1 when coupled to the MM1 is at least 100 times greater than the $K_d$ of the AB2 when coupled to the MM2. In some embodiments, the coupling of each of the MM reduces the ability of the corresponding AB to bind its target or epitope such that the dissociation constant ($K_d$) of the AB1 when coupled to the MM1 is at least 100 times lower than the $K_d$ of the AB2 when coupled to the MM2.

In some embodiments, the coupling of each of the MM reduces the ability of the corresponding AB to bind its target or epitope such that the dissociation constant ($K_d$) of the AB1 when coupled to the MM1 is at least 1,000 times greater than the $K_d$ of the AB2 when coupled to the MM2. In some embodiments, the coupling of each of the MM reduces the ability of the corresponding AB to bind its target or epitope such that the dissociation constant ($K_d$) of the AB1 when coupled to the MM1 is at least 1,000 times lower than the $K_d$ of the AB2 when coupled to the MM2.

In some embodiments, the coupling of each of the MM reduces the ability of the corresponding AB to bind its target or epitope such that the dissociation constant ($K_d$) of the AB1 when coupled to the MM1 is at least 10,000 times greater than the $K_d$ of the AB2 when coupled to the MM2.

In some embodiments, the coupling of each of the MM reduces the ability of the corresponding AB to bind its target or epitope such that the dissociation constant ($K_d$) of the AB1 when coupled to the MM1 is at least 10,000 times lower than the $K_d$ of the AB2 when coupled to the MM2.

In some embodiments, each of the MM is an amino acid sequence selected from a MM shown in the Examples provided herein.

In some embodiments, the protease that cleaves the first cleavable moiety (CM1) sequence is produced by a tumor that is in proximity to cells that express the target and/or produced by a tumor that is co-localized with the target of the AB1 in the multispecific activatable antibody in a tissue, and the protease cleaves the CM1 in the multispecific activatable antibody when the multispecific activatable antibody is exposed to the protease.

In some embodiments, the multispecific activatable antibody includes more than one cleavable moiety sequence, and the protease that cleaves at least one cleavable moiety sequence is produced by a tumor that is in proximity to cells that express the target and/or produced by a tumor that is co-localized with the target of at least one of the AB regions in the multispecific activatable antibody in a tissue, and the protease cleaves the CM in the multispecific activatable antibody when the multispecific activatable antibody is exposed to the protease.

In some embodiments, each CM, e.g., CM1 and at least CM2, is positioned in the multispecific activatable antibody such that when the activatable antibody is in the uncleaved state, binding of the multispecific activatable antibody to a target of one of the AB regions is reduced to occur with a dissociation constant that is at least 20-fold greater than the dissociation constant of an unmodified AB binding to its target, and whereas when the activatable antibody is in the cleaved state, the AB binds its target.

In some embodiments, each CM is positioned in the multispecific activatable antibody such that when the activatable antibody is in the uncleaved state, binding of the multispecific activatable antibody to a target of one of the AB regions is reduced to occur with a dissociation constant that is at least 40-fold greater than the dissociation constant of an unmodified AB binding to its target, and whereas when the activatable antibody is in the cleaved state, the AB binds its target.

In some embodiments, each CM is positioned in the multispecific activatable antibody such when the activatable antibody is that in the uncleaved state, binding of the multispecific activatable antibody to a target of one of the AB regions is reduced to occur with a dissociation constant that is at least 50-fold greater than the dissociation constant of an unmodified AB binding to its target, and whereas when the activatable antibody is in the cleaved state, the AB binds its target.

In some embodiments, each CM is positioned in the multispecific activatable antibody such when the activatable antibody is that in the uncleaved state, binding of the multispecific activatable antibody to a target of one of the AB regions is reduced to occur with a dissociation constant that is at least 100-fold greater than the dissociation constant of an unmodified AB binding to its target, and whereas when the activatable antibody is in the cleaved state, the AB binds its target.

In some embodiments, each CM is positioned in the multispecific activatable antibody such that when the activatable antibody is in the uncleaved state, binding of the multispecific activatable antibody to a target of one of the AB regions is reduced to occur with a dissociation constant that is at least 200-fold greater than the dissociation constant of an unmodified AB binding to its target, and whereas when the activatable antibody is in the cleaved state, the AB binds its target.

In some embodiments, each CM in the multispecific activatable antibody is a polypeptide of up to 15 amino acids in length.

In some embodiments, at least one CM in the multispecific activatable antibody includes the amino acid sequence LSGRSDNH (SEQ ID NO: 67). In some embodiments, at least one cleavable moiety is selected for use with a specific protease, for example a protease that is known to be produced by a tumor that is in proximity to cells that express the target and/or produced by a tumor that is co-localized with at least one target of the multispecific activatable antibody. For example, suitable cleavable moieties for use in the multispecific activatable antibodies of the disclosure are cleaved by at least a protease such as urokinase, legumain, and/or matriptase (also referred to herein as MT-SP1 or MTSP1). In some embodiments, a suitable cleavable moiety includes at least one of the following sequences: TGRGPSWV (SEQ ID NO: 68); SARGPSRW (SEQ ID NO: 69); TARGPSFK (SEQ ID NO: 70); LSGRSDNH (SEQ ID NO: 67); GGWHTGRN (SEQ ID NO: 71); HTGRSGAL (SEQ ID NO: 72); PLTGRSGG (SEQ ID NO: 73); AARGPAIH (SEQ ID NO: 74); RGPAFNPM (SEQ ID NO: 75); SSRGPAYL (SEQ ID NO: 76); RGPATPIM (SEQ ID NO: 77); RGPA (SEQ ID NO: 78); GGQPSGMWGW (SEQ ID NO: 79); FPRPLGITGL (SEQ ID NO: 80); VHMPLGFLGP (SEQ ID NO: 81); SPLTGRSG (SEQ ID NO: 82); SAGFSLPA (SEQ ID NO: 83); LAPLGLQRR (SEQ ID NO: 84); SGGPLGVR (SEQ ID NO: 85); and/or PLGL (SEQ ID NO: 86).

In some embodiments, each CM in the multispecific activatable antibody is a substrate for a protease selected from the group consisting of those shown in Table 3. In some embodiments, the protease is selected from the group consisting of uPA, legumain, matriptase, ADAM17, BMP-1, TMPRSS3, TMPRSS4, neutrophil elastase, MMP-7, MMP-9, MMP-12, MMP-13, and MMP-14. In some embodiments, the protease is a cathepsin, such as, but not limited to, cathepsin S. In some embodiments, each CM in the multispecific activatable antibody is a substrate for a protease selected from the group consisting of uPA (urokinase plasminogen activator), legumain and matriptase. In some embodiments, the protease comprises uPA. In some embodiments, the protease comprises legumain. In some embodiments, the protease comprises matriptase. In some embodiments, the protease comprises a matrix metalloproteinase (MMP).

In some embodiments, at least one CM in the multispecific activatable antibody is a substrate for at least two proteases. In some embodiments, each protease is selected from the group consisting of those shown in Table 3. In some embodiments, at least one CM in the multispecific activatable antibody is a substrate for at least two proteases, wherein one of the proteases is selected from the group consisting of uPA, legumain and matriptase and the other protease is selected from the group consisting of those shown in Table 3. In some embodiments, at least one CM in the multispecific activatable antibody is a substrate for at least two proteases selected from the group consisting of uPA, legumain and matriptase.

In some embodiments, at least one of the proteases that can cleave each CM in the multispecific activatable antibody is the same protease. In some embodiments, the same protease that can cleave both CMs in the multispecific activatable antibody is selected from the group consisting of those shown in Table 3. In some embodiments, the same protease that can cleave both CMs in the multispecific activatable antibody are selected from the group consisting of uPA, legumain and matriptase.

In some embodiments, at least two of the proteases that can cleave each CM in the multispecific activatable antibody are the same two proteases. In some embodiments, the same two proteases that can cleave both CMs in the multispecific activatable antibody are selected from the group consisting of those shown in Table 3. In some embodiments, at least one of the at least the two proteases that can cleave both CMs in the multispecific activatable antibody is selected from the group consisting of uPA, legumain and matriptase, and the other protease of the at least two proteases is selected from the group consisting of those shown in Table 3. In some embodiments, the at least the two proteases that can cleave both CMs in the multispecific activatable antibody are selected from the group consisting of uPA, legumain and matriptase.

In some embodiments, at least one of the proteases that can cleave CM1 is different than at least one of the proteases that can cleave CM2 in the multispecific activatable antibody. In some embodiments, at least one of the proteases that can cleave CM1 but cannot cleave CM2 in the multispecific activatable antibody. In some embodiments, at least one of the proteases that can cleave CM2 but cannot cleave CM1 in the multispecific activatable antibody. In some embodiments, the at least one protease that can cleave CM1 but cannot cleave CM2 in the multispecific activatable antibody is selected from the group consisting of those shown in Table 3. In some embodiments, the at least one protease that can cleave CM1 but cannot cleave CM2 in the multispecific activatable is selected from the group consisting of uPA, legumain and matriptase.

In some embodiments, the multispecific activatable antibody includes at least a first CM (CM1) and a second CM (CM2). In some embodiments, CM1 and CM2 are part of a single cleavable linker that joins an MM to an AB. In some embodiments, CM1 is part of a cleavable linker that joins MM1 to AB1, and CM2 is part of a separate cleavable linker that joins an MM2 to AB2. In some embodiments, a multispecific activatable antibody comprises more than two CMs. In some embodiments, such a multispecific activatable antibody comprises more than two CMs and more than two MMs. In some embodiments, CM1 and CM2 are each polypeptides of no more than 15 amino acids long. In some embodiments, at least one of the first CM and the second CM is a polypeptide that functions as a substrate for a protease selected from the group consisting of those listed in Table 3. In some embodiments, at least one of the first CM and the second CM is a polypeptide that functions as a substrate for a protease selected from the group consisting of uPA, legumain, and matriptase. In some embodiments, the first CM is cleaved by a first cleaving agent selected from the group consisting of uPA, legumain, and matriptase in a target tissue and the second CM is cleaved by a second cleaving agent in a target tissue. In some embodiments, the other protease is selected from the group consisting of those shown in Table 3. In some embodiments, the first cleaving agent and the second cleaving agent are the same protease selected from the group consisting of those listed in Table 3, and the first CM and the second CM are different substrates for the protease. In some embodiments, the first cleaving agent and the second cleaving agent are the same protease selected from the group consisting of uPA, legumain, and matriptase, and the first CM and the second CM are different substrates for the protease. In some embodiments, the first cleaving agent and the second cleaving agent are the same protease selected from the group listed in Table 3, and the first CM and the second CM are the same substrate. In some embodiments, the first cleaving agent and the second cleaving agent are different proteases. In some embodiments, the first cleaving agent and the second cleaving agent are different proteases selected from the group consisting of those shown in Table 3. In some embodiments, the first cleaving agent and the second cleaving agent are produced by a tumor that is in proximity to cells that express the target and/or produced by a tumor that is co-localized in the target tissue. In some embodiments, the first CM and the second CM are cleaved by at least one cleaving agent in the target tissue.

In some embodiments, the multispecific activatable antibody is exposed to and cleaved by a protease such that, when the activatable antibody is in the activated or cleaved state, the activated multispecific activatable antibody includes a light chain amino acid sequence that includes at least a portion of LP2 and/or CM sequence after the protease has cleaved the CM.

In some embodiments, the multispecific activatable antibody also includes a signal peptide. In some embodiments, the signal peptide is conjugated to the multispecific activatable antibody via a spacer. In some embodiments, the spacer is conjugated to the multispecific activatable antibody in the absence of a signal peptide. In some embodiments, the spacer is joined directly to at least one of the MM of the multispecific activatable antibody.

In some embodiments, the multispecific activatable antibody in an uncleaved state comprises a spacer that is joined directly to a first MM and has the structural arrangement from N-terminus to C-terminus of spacer-MM1-CM-AB1. In some embodiments, the spacer includes at least the amino acid sequence QGQSGQ (SEQ ID NO: 87).

In some embodiments, the serum half-life of the multispecific activatable antibody is longer than that of the corresponding multispecific antibody; e.g., the pK of the multispecific activatable antibody is longer than that of the corresponding multispecific antibody. In some embodiments, the serum half-life of the multispecific activatable antibody is similar to that of the corresponding multispecific antibody. In some embodiments, the serum half-life of the multispecific activatable antibody is at least 15 days when administered to an organism. In some embodiments, the serum half-life of the multispecific activatable antibody is at least 12 days when administered to an organism. In some embodiments, the serum half-life of the multispecific activatable antibody is at least 11 days when administered to an organism. In some embodiments, the serum half-life of the multispecific activatable antibody is at least 10 days when administered to an organism. In some embodiments, the serum half-life of the multispecific activatable antibody is at least 9 days when administered to an organism. In some embodiments, the serum half-life of the multispecific activatable antibody is at least 8 days when administered to an organism. In some embodiments, the serum half-life of the multispecific activatable antibody is at least 7 days when administered to an organism. In some embodiments, the serum half-life of the multispecific activatable antibody is at least 6 days when administered to an organism. In some embodiments, the serum half-life of the multispecific activatable antibody is at least 5 days when administered to an organism. In some embodiments, the serum half-life of the multispecific activatable antibody is at least 4 days when administered to an organism. In some embodiments, the serum half-life of the multispecific activatable antibody is at least 3 days when administered to an organism. In some embodiments, the serum half-life of the multispecific activatable antibody is at least 2 days when administered to an organism. In some embodiments, the serum half-life of the multispecific activatable antibody is at least 24 hours when administered to an organism. In some embodiments, the serum half-life of the multispecific activatable antibody is at least 20 hours when administered to an organism. In some embodiments, the serum half-life of the multispecific activatable antibody is at least 18 hours when administered to an organism. In some embodiments, the serum half-life of the multispecific activatable antibody is at least 16 hours when administered to an organism. In some embodiments, the serum half-life of the multispecific activatable antibody is at least 14 hours when administered to an organism. In some embodiments, the serum half-life of the multispecific activatable antibody is at least 12 hours when administered to an organism. In some embodiments, the serum half-life of the multispecific activatable antibody is at least 10 hours when administered to an organism. In some embodiments, the serum half-life of the multispecific activatable antibody is at least 8 hours when administered to an organism. In some embodiments, the serum half-life of the multispecific activatable antibody is at least 6 hours when administered to an organism. In some embodiments, the serum half-life of the multispecific activatable antibody is at least 4 hours when administered to an organism. In some embodiments, the serum half-life of the multispecific activatable antibody is at least 3 hours when administered to an organism.

The disclosure also provides compositions and methods that include a multispecific activatable antibody that includes at least a first antibody or antibody fragment (AB1) that specifically binds a target and a second antibody or antibody fragment (AB2), where at least the first AB in the multispecific activatable antibody is coupled to a masking moiety (MM1) that decreases the ability of AB1 to bind its target. In some embodiments, each AB is coupled to a MM that decreases the ability of its corresponding AB to each target. For example, in bispecific activatable antibody embodiments, AB1 is coupled to a first masking moiety (MM1) that decreases the ability of AB1 to bind its target, and AB2 is coupled to a second masking moiety (MM2) that decreases the ability of AB2 to bind its target. In some embodiments, the multispecific activatable antibody comprises more than two AB regions; in such embodiments, AB1 is coupled to a first masking moiety (MM1) that decreases the ability of AB1 to bind its target, AB2 is coupled to a second masking moiety (MM2) that decreases the ability of AB2 to bind its target, AB3 is coupled to a third masking moiety (MM3) that decreases the ability of AB3 to bind its target, and so on for each AB in the multispecific activatable antibody.

In some embodiments, the multispecific activatable antibody further includes at least one cleavable moiety (CM) that is a substrate for a protease, where the CM links a MM to an AB. For example, in some embodiments, the multispecific activatable antibody includes at least a first antibody or antibody fragment (AB1) that specifically binds a target and a second antibody or antibody fragment (AB2), where at least the first AB in the multispecific activatable antibody is coupled via a first cleavable moiety (CM1) to a masking moiety (MM1) that decreases the ability of AB1 to bind its target. In some bispecific activatable antibody embodiments, AB1 is coupled via CM1 to MM1, and AB2 is coupled via a second cleavable moiety (CM2) to a second masking moiety (MM2) that decreases the ability of AB2 to bind its target. In some embodiments, the multispecific activatable antibody comprises more than two AB regions; in some of these embodiments, AB1 is coupled via CM1 to MM1, AB2 is coupled via CM2 to MM2, and AB3 is coupled via a third cleavable moiety (CM3) to a third masking moiety (MM3) that decreases the ability of AB3 to bind its target, and so on for each AB in the multispecific activatable antibody.

In some embodiments, the multispecific antibodies and/or multispecific activatable antibodies described herein are used in conjunction with one or more additional agents or a combination of additional agents. Suitable additional agents include current pharmaceutical and/or surgical therapies for an intended application, such as, for example, cancer. For example, the multispecific antibodies and/or multispecific activatable antibodies can be used in conjunction with an additional chemotherapeutic or anti-neoplastic agent.

In some embodiments, the multispecific antibody and/or multispecific activatable antibody and additional agent are formulated into a single therapeutic composition, and the multispecific antibody and/or multispecific activatable antibody and additional agent are administered simultaneously. In some embodiments, the multispecific antibody and/or multispecific activatable antibody and additional agent are separate from each other, e.g., each is formulated into a separate therapeutic composition, and the multispecific antibody and/or multispecific activatable antibody and the additional agent are administered simultaneously, or the multispecific antibody and/or multispecific activatable antibody and the additional agent are administered at different times during a treatment regimen. For example, the multispecific antibody and/or multispecific activatable antibody is administered prior to the administration of the additional agent, the multispecific antibody and/or multispecific activatable antibody is administered subsequent to the administration of the additional agent, or the multispecific antibody and/or multispecific activatable antibody and the additional agent are administered in an alternating fashion. As described herein, the anti-multispecific antibody and/or multispecific activatable antibody and additional agent are administered in single doses or in multiple doses.

The disclosure also provides an isolated nucleic acid molecule encoding at least a portion of a multispecific antibody and/or multispecific activatable antibody described herein, such as for example, at least a first nucleic acid encoding at least a portion of the heavy chain of the multispecific antibody and/or multispecific activatable antibody and a second nucleic acid encoding at least a portion of the light chain of multispecific antibody and/or multispecific the activatable antibody, as well as vectors that include these isolated nucleic acid sequences. The disclosure provides methods of producing a multispecific antibody and/or multispecific activatable antibody by culturing a cell under conditions that lead to expression of the multispecific antibody and/or multispecific activatable antibody, wherein the cell comprises such a nucleic acid molecule(s). In some embodiments, the cell comprises such a vector.

The disclosure also provides a method of manufacturing multispecific antibodies of the disclosure and/or multispecific activatable antibodies of the disclosure by (a) culturing a cell comprising a nucleic acid construct that encodes the multispecific antibody and/or multispecific activatable antibody under conditions that lead to expression of the multispecific antibody and/or multispecific activatable, and (b) recovering the multispecific antibody and/or multispecific activatable antibody.

The present disclosure also provides methods of treating, preventing, delaying the progression of or otherwise ameliorating a symptom of one or more pathologies or alleviating a symptom associated with such pathologies, by administering an anti-CD3ε antibody, an activatable anti-CD3ε antibody, a multispecific antibody that specifically binds CD3ε and/or a multispecific activatable antibody of the disclosure that specifically binds CD3ε to a subject in which such treatment or prevention is desired. The subject to be treated is, e.g., human or other mammal. In some embodiments, the subject is a non-human mammal, such as a non-human primate, companion animal (e.g., cat, dog, horse), farm animal, work animal, or zoo animal. In some embodiments, the subject is a rodent.

The present disclosure also provides methods to induce target-dependent T-cell activation and killing of a target cell by administering a multispecific activatable antibody of the disclosure to a subject in which such induction is desired, wherein when the multispecific activatable antibody is in the cleaved state, e.g., each masking moiety in the multispecific activatable antibody is no longer attached or otherwise associated with the corresponding AB domain, target-dependent T-cell activation and killing of the target cell occurs, and when the multispecific activatable antibody is in the uncleaved state, e.g. at least one masking moiety of the multispecific activatable antibody is attached or otherwise associated with the corresponding AB domain, target-dependent T-cell activation and killing of the target cell is reduced or otherwise inhibited. Any of the multispecific activatable antibodies described herein are suitable for use in such methods. The subject to be treated is, e.g., human or other mammal. In some embodiments, the subject is a non-human mammal, such as a non-human primate, companion animal (e.g., cat, dog, horse), farm animal, work animal, or zoo animal. In some embodiments, the subject is a rodent.

An anti-CD3ε antibody, an activatable anti-CD3ε antibody, a multispecific antibody that specifically binds CD3ε and/or a multispecific activatable antibody of the disclosure that specifically binds CD3ε used in any of the embodiments of these methods and uses can be administered at any stage of the disease. For example, such an antibody, an activatable antibody, a multispecific antibody and/or a multispecific activatable antibody can be administered to a patient suffering cancer of any stage, from early to metastatic. The terms subject and patient are used interchangeably herein.

An anti-CD3ε antibody, an activatable anti-CD3ε antibody, a multispecific antibody that specifically binds CD3ε and/or a multispecific activatable antibody of the disclosure that specifically binds CD3ε used in any of the embodiments of these methods and uses can be used in a treatment regimen comprising neoadjuvant therapy.

An anti-CD3ε antibody, an activatable anti-CD3ε antibody, a multispecific antibody that specifically binds CD3ε and/or a multispecific activatable antibody of the disclosure that specifically binds CD3ε used in any of the embodiments of these methods and uses can be administered either alone or in combination with one or more additional agents, including small molecule inhibitors, other antibody-based therapies, polypeptide or peptide-based therapies, nucleic acid-based therapies and/or other biologics. In some embodiments, an antibody, an activatable antibody, a multispecific antibody, and/or a multispecific activatable antibody is administered in combination with one or more additional agents such as, by way of non-limiting example, a chemotherapeutic agent, such as an alkylating agent, an anti-metabolite, an anti-microtubule agent, a topoisomerase inhibitor, a cytotoxic antibiotic, and any other nucleic acid damaging agent. In some embodiments, the additional agent is a taxane, such as paclitaxel (e.g., Abraxane®). In some embodiments, the additional agent is an anti-metabolite, such as gemcitabine. In some embodiments, the additional agent is an alkylating agent, such as platinum-based chemotherapy, such as carboplatin or cisplatin. In some embodiments, the additional agent is a targeted agent, such as a kinase inhibitor, e.g., sorafenib or erlotinib. In some embodiments, the additional agent is a targeted agent, such as another antibody, e.g., a monoclonal antibody (e.g., bevacizumab), a bispecific antibody, or a multispecific antibody. In some embodiments, the additional agent is a proteosome inhibitor, such as bortezomib or carfilzomib. In some embodiments, the additional agent is an immune modulating agent, such as lenolidominde or IL-2. In some embodiments, the additional agent is radiation. In some embodiments, the additional agent is an agent considered standard of care by those skilled in the art. In some embodiments, the additional agent is a chemotherapeutic agent well known to those skilled in the art. In some embodiments, the antibody, activatable antibody, multispecific antibody, and/or multispecific activatable antibody, and the additional agent(s) are formulated in a single composition. In some embodiments, the antibody, activatable antibody, multispecific antibody, and/or multispecific activatable antibody, and the additional agent(s) are administered as two or more separate compositions. In some embodiments, the antibody, activatable antibody, multispecific antibody, and/or multispecific activatable antibody, and the additional agent(s) are administered simultaneously. In some embodiments, the antibody, activatable antibody, multispecific antibody, and/or multispecific activatable antibody, and the additional agent(s) are administered sequentially.

In some embodiments, the additional agent(s) is a chemotherapeutic agent, such as a chemotherapeutic agent selected from the group consisting of docetaxel, paclitaxel, abraxane (i.e., albumin-conjugated paclitaxel), doxorubicin, oxaliplatin, carboplatin, cisplatin, irinotecan, and gemcitabine.

In some embodiments, the additional agent(s) is a checkpoint inhibitor, a kinase inhibitor, an agent targeting inhibitors in the tumor microenvironment, and/or a T cell or NK agonist. In some embodiments, the additional agent(s) is radiation therapy, alone or in combination with another additional agent(s) such as a chemotherapeutic or antineoplastic agent. In some embodiments, the additional agent(s) is a vaccine, an oncovirus, and/or a DC-activating agent such as, by way of non-limiting example, a toll-like receptor (TLR) agonist and/or α-CD40. In some embodiments, the additional agent(s) is a tumor-targeted antibody designed to kill the tumor via ADCC or via direct conjugation to a toxin (e.g., an antibody drug conjugate (ADC).

In some embodiments, the checkpoint inhibitor is an inhibitor of a target selected from the group consisting of CTLA-4, LAG-3, PD-1, PDL1, TIGIT, TIM-3, B7H4, and Vista. In some embodiments, the kinase inhibitor is selected from the group consisting of B-RAFi, MEKi, and Btk inhibitors, such as ibrutinib. In some embodiments, the kinase inhibitor is crizotinib. In some embodiments, the tumor microenvironment inhibitor is selected from the group consisting of an IDO inhibitor, an α-CSF1R inhibitor, an α-CCR4 inhibitor, a TGF-beta, a myeloid-derived suppressor cell, or a T-regulatory cell. In some embodiments, the agonist is selected from the group consisting of Ox40, GITR, CD137, ICOS, CD27, and HVEM. In some embodiments, the checkpoint inhibitor is an antibody that binds a target selected from CTLA-4, PD-1, and/or PD-L1. In some embodiments, the checkpoint inhibitor is an anti-CTLA4 antibody, an anti-PD-1 antibody, and an anti-PD-L1 antibody, and/or combinations thereof. In some embodiments, the checkpoint inhibitor is an anti-CTLA4 antibody such as, e.g., Yervoy™. In some embodiments, the checkpoint inhibitor is an anti-PD-1 antibody such as, e.g., Opdivo™ and/or Keytruda™.

In some embodiments, the inhibitor is a CTLA-4 inhibitor. In some embodiments, the inhibitor is a LAG-3 inhibitor. In some embodiments, the inhibitor is a PD-1 inhibitor. In some embodiments, the inhibitor is a PDL1 inhibitor. In some embodiments, the inhibitor is a TIGIT inhibitor. In some embodiments, the inhibitor is a TIM-3 inhibitor. In some embodiments, the inhibitor is a B7H4 inhibitor. In some embodiments, the inhibitor is a Vista inhibitor. In some embodiments, the inhibitor is a B-RAFi inhibitor. In some embodiments, the inhibitor is a MEKi inhibitor. In some embodiments, the inhibitor is a Btk inhibitor. In some embodiments, the inhibitor is ibrutinib. In some embodiments, the inhibitor is crizotinib. In some embodiments, the inhibitor is an IDO inhibitor. In some embodiments, the inhibitor is an α-CSF1R inhibitor. In some embodiments, the inhibitor is an α-CCR4 inhibitor. In some embodiments, the inhibitor is a TGF-beta. In some embodiments, the inhibitor is a myeloid-derived suppressor cell. In some embodiments, the inhibitor is a T-regulatory cell.

In some embodiments, the agonist is Ox40. In some embodiments, the agonist is GITR. In some embodiments, the agonist is CD137. In some embodiments, the agonist is ICOS. In some embodiments, the agonist is CD27. In some embodiments, the agonist is HVEM.

In some embodiments, the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against the same target as the first antibody or antigen-binding fragment thereof, the first conjugated antibody or antigen-binding fragment thereof, activatable antibody or antigen-binding fragment thereof and/or a conjugated activatable antibody or antigen-binding fragment thereof, e.g., against PDL1. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against a target different than the target of the first antibody or antigen-binding fragment thereof, the first conjugated antibody or antigen-binding fragment thereof, activatable antibody or antigen-binding fragment thereof and/or a conjugated activatable antibody or antigen-binding fragment thereof.

In some embodiments, the anti-CD3ε antibody and/or activatable antibody is administered during and/or after treatment in combination with one or more additional agents such as, for example, a chemotherapeutic agent, an anti-inflammatory agent, and/or a an immunosuppressive agent. In some embodiments, the anti-CD3ε antibody and/or activatable antibody and the additional agent are formulated into a single therapeutic composition, and the anti-CD3ε antibody and/or activatable antibody and additional agent are administered simultaneously. Alternatively, the anti-CD3ε antibody and/or activatable antibody and additional agent are separate from each other, e.g., each is formulated into a separate therapeutic composition, and the anti-CD3ε antibody and/or activatable antibody and the additional agent are administered simultaneously, or the anti-CD3ε antibody and/or activatable antibody and the additional agent are administered at different times during a treatment regimen. For example, the anti-CD3ε antibody and/or activatable antibody is administered prior to the administration of the additional agent, the anti-CD3ε antibody and/or activatable antibody is administered subsequent to the administration of the additional agent, or the anti-CD3ε antibody and/or activatable antibody and the additional agent are administered in an alternating fashion. As described herein, the anti-CD3ε antibody and/or activatable antibody and additional agent are administered in single doses or in multiple doses.

In some embodiments, the anti-CD3ε antibody and/or activatable antibody and the additional agent(s) are administered simultaneously. For example, the anti-CD3ε antibody and/or activatable antibody and the additional agent(s) can be formulated in a single composition or administered as two or more separate compositions. In some embodiments, the anti-CD3ε antibody and/or activatable antibody and the additional agent(s) are administered sequentially, or the anti-CD3ε antibody and/or activatable antibody and the additional agent are administered at different times during a treatment regimen.

The disclosure also provides methods and kits for using the anti-CD3ε antibody, activatable anti-CD3ε antibody, multispecific antibody that specifically binds CD3ε and/or multispecific activatable antibody of the disclosure that specifically binds CD3ε in a variety of diagnostic and/or prophylactic indications. For example, the disclosure provides methods and kits for detecting presence or absence of a cleaving agent and a target of interest in a subject or a sample by (i) contacting a subject or sample with an activatable antibody or a multispecific activatable antibody that includes at least a first masking moiety (MM1), a first cleavable moiety (CM1) that is cleaved by the cleaving agent, and at least a first antigen binding domain or fragment thereof (AB1) that specifically binds the target of interest, (a) wherein the MM1 is a peptide that inhibits binding of the AB1 to the target, and wherein the MM1 does not have an amino acid sequence of a naturally occurring binding partner of the AB1 and is not a modified form of a natural binding partner of the AB1; and (b) wherein, in an uncleaved, non-activated state, the MM1 interferes with specific binding of the AB1 to the target, and in a cleaved, activated state the MM1 does not interfere or compete with specific binding of the AB1 to the target; and (ii) measuring a level of activated antibody or activated multispecific activatable antibody in the subject or sample, wherein a detectable level of activated antibody or activated multispecific activatable antibody in the subject or sample indicates that the cleaving agent and the target are present in the subject or sample and wherein no detectable level of activated antibody or activated multispecific activatable antibody in the subject or sample indicates that the cleaving agent, the target or both the cleaving agent and the target are absent and/or not sufficiently present in the subject or sample.

In some embodiments, the activatable antibody or activatable multispecific activatable antibody is an activatable antibody or an activatable multispecific activatable antibody to which a therapeutic agent is conjugated. In some embodiments, the activatable antibody or activatable multispecific activatable antibody is not conjugated to an agent. In some embodiments, the activatable antibody or activatable multispecific activatable antibody comprises a detectable label. In some embodiments, the detectable label is positioned on the AB1. In some embodiments, measuring the level of activatable antibody or multispecific activatable antibody in the subject or sample is accomplished using a secondary reagent that specifically binds to the activatable antibody or activatable multispecific activatable antibody, wherein the reagent comprises a detectable label. In some embodiments, the secondary reagent is an antibody comprising a detectable label.

In some embodiments of these methods and kits, the activatable antibody or multispecific activatable antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods and kits, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods, the method is an in vivo method. In some embodiments of these methods, the method is an in situ method. In some embodiments of these methods, the method is an ex vivo method. In some embodiments of these methods, the method is an in vitro method.

In some embodiments of the methods and kits, the method or kit is used to identify or otherwise refine a patient population suitable for treatment with a multispecific activatable antibody of the disclosure. For example, patients that test positive for both the target and a protease that cleaves the substrate in the first cleavable moiety (CM1) of the multispecific activatable antibody being tested in these methods are identified as suitable candidates for treatment with such an activatable antibody or a multispecific activatable antibody comprising such a CM1. Likewise, patients that test negative for both the target and the protease that cleaves the substrate in the CM1 in the activatable antibody or multispecific activatable antibody being tested using these methods might be identified as suitable candidates for another form of therapy.

In some embodiments, a method or kit is used to identify or otherwise refine a patient population suitable for treatment with an activatable antibody and/or a multispecific activatable antibody of the disclosure, followed by treatment by administering that activatable antibody and/or multispecific activatable antibody to a subject in need thereof. For example, patients that test positive for both the target and a protease that cleaves the substrate in the first cleavable moiety (CM1) of the activatable antibody and/or multispecific activatable antibody being tested in these methods are identified as suitable candidates for treatment with an activatable antibody and/or a multispecific activatable antibody comprising such a CM1, and the patient is then administered a therapeutically effective amount of the activatable antibody and/or the multispecific activatable antibody that was tested. Likewise, patients that test negative for either or both of the target and the protease that cleaves the substrate in the CM1 in the activatable antibody and/or multispecific activatable antibody being tested using these methods might be identified as suitable candidates for another form of therapy.

In some embodiments, such patients can be tested with other activatable antibodies, conjugated activatable antibodies or multispecific antibodies and/or multispecific activatable antibodies and/or conjugated multispecific activatable antibodies until a suitable activatable antibody or conjugated activatable antibody or multispecific activatable antibody and/or conjugated multispecific activatable antibody for treatment is identified, e.g., an activatable antibody or a conjugated activatable antibody or a multispecific activatable antibody and/or conjugated multispecific activatable antibody comprising a CM that is cleaved by the patient at the site of disease. In some embodiments, the patient is then administered a therapeutically effective amount of the activatable antibody or conjugated activatable antibody or multispecific activatable antibody and/or conjugated multispecific activatable antibody for which the patient tested positive.

Pharmaceutical compositions according to the disclosure can include a multispecific antibody and/or a multispecific activatable antibody of the disclosure and a carrier. These pharmaceutical compositions can be included in kits, such as, for example, diagnostic kits.

One skilled in the art will appreciate that the antibodies of the disclosure have a variety of uses. For example, the proteins of the disclosure are used as therapeutic agents for a variety of disorders. The antibodies of the disclosure are also used as reagents in diagnostic kits or as diagnostic tools, or these antibodies can be used in competition assays to generate therapeutic reagents.

BRIEF DESCRIPTION OF DRAWINGS

FIG. 1A depicts SP34scFv(LvHv)-Fc and SP34scFv(HvLv)-Fc binding as a function of Fc fusion protein concentration. FIG. 2B depicts mouse SP34-2 IgG1 binding as a function of concentration.

FIG. 4A depicts component pieces for scFv-Fc antibodies. FIG. 4B depicts scFv(LvHv)-Fc and scFv(HvLv)-Fc antibodies of the disclosure.

FIG. 4C depicts activatable antibodies comprising scFv(LvHv)-Fc or scFv(HvLv)-Fc antibodies of the disclosure.

FIG. 5A depicts a multispecific antibody of the disclosure that comprises an Ig antibody and a scFv. FIG. 5B depicts a multispecific activatable antibody of the disclosure in which the primary antibody site is masked. FIG. 5C depicts a multispecific activatable antibody of the disclosure in which the secondary scFv site is masked. FIG. 5D depicts a multispecific activatable antibody of the disclosure in which the with primary antibody and secondary scFv sites are masked.

FIGS. 8A, 8B, 8C, 8D, 8E, 8F, 8G, 8H, 8I, and 8J are a series of schematic diagrams of a selected set of the possible permutations of multispecific activatable antibodies of the disclosure. In particular, this figure shows multispecific activatable antibodies in which the primary antigen binding site is masked (i.e., activatable) and the additional antigen-binding domain(s) is not masked.

FIGS. 11A, 11B, 11C, 11D, 11E, 11F, 11G, 11H, 11I, and 11J are a series of schematic diagrams of an array of multispecific activatable antibodies in which the majority, but not all of the antigen-binding domains, are masked and at least one additional antigen-binding domain(s) is not masked.

FIGS. 12A, 12B, 12C, and 12D are a series of schematic diagrams of an array of multispecific activatable antibodies in which the primary antigen-binding domain and another antigen-binding domain are masked, and the remaining antigen-binding domain(s) is not masked.

FIG. 13A is a graph depicting the ability of both orientations of the SP34scFv-Fc to bind to CD3ε Jurkat cells. FIG. 13B is a graph depicting the binding of SP34-2 IgG. All formats of SP34 bind with similar $EC_{50}$ values.

FIGS. 15A, 15B, 15C, and 15D are a series of graphs depicting that the CD3ε masking peptides shift the $EC_{50}$ of CD3ε binding in an EGFR masked, multispecific activatable antibody that utilize two versions of an SP34 scFv while retaining effective EGFR masking.

FIGS. 16A and 16B are a series of graphs depicting that the cytotoxicity $EC_{50}$ of CD3ε and EGFR masked multispecific, activatable antibodies are shifted relative to an unmasked control. This was evident with two versions of the SP34 scFv, namely the scFv in CI023 and CI024 versus the scFv in CI011 and CI010.

FIGS. 17A and 17B are a series of graphs depicting that in the context of a multi-specific, activatable antibody, the EGFR binding $EC_{50}$ is unaffected by the presence or absence of both CD3ε masks; likewise, CD3ε $EC_{50}$ is unaffected by the presence or absence of the EGFR mask.

FIGS. 18A and 18B are a series of graphs depicting that the largest shift in cytotoxicity $EC_{50}$ is obtained by masking both EGFR and CD3 binding. In addition, the cytotoxicity of the multispecific antibody and multispecific activatable antibodies is EGFR dependent.

FIG. 19 is a graph depicting that the largest shift in activation $EC_{50}$ is obtained by masking both EGFR and CD3 binding.

FIGS. 21A, 21B, 21C, and 21D are a series of graphs depicting that uPA activation restores binding of the multi-specific, activatable CI011 (M-EGFR/M-hCD3) antibody. Cell killing of all multispecific, activatable antibodies is restored by uPA activation.

FIG. 22 is a graph depicting the ability of dually masked multi specific, activatable antibodies that contain different substrates to shift $EC_{50}$ cytotoxicity.

FIG. 30 shows that mouse CD3ε masks incorporated into an EGFR masked, multispecific, activatable antibody shift the EC50 of binding to mouse CD3 while retaining effective EGFR masking.

DETAILED DESCRIPTION

Figure 1:
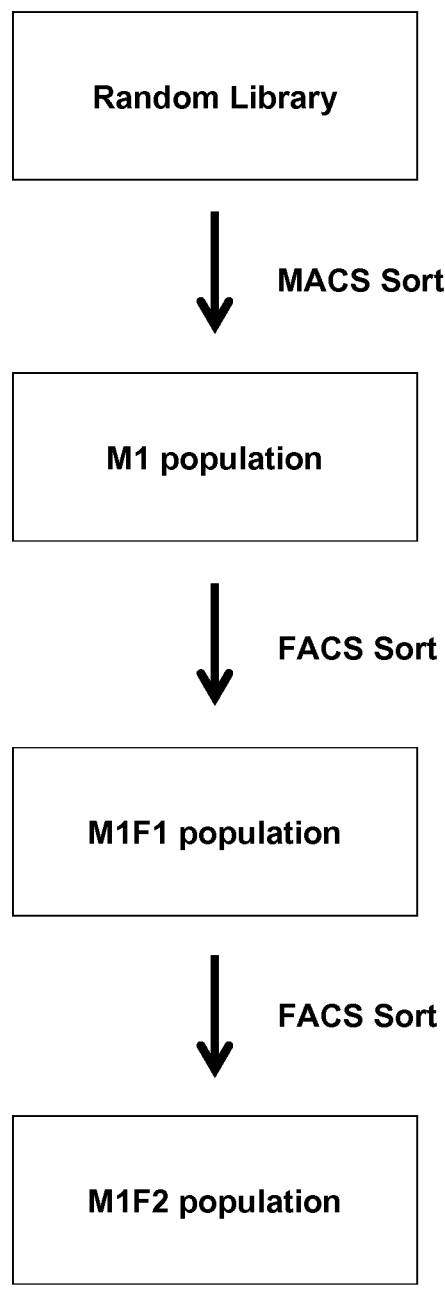
FIG. 1 is an illustration depicting generic mask selection population nomenclature used herein.

The present disclosure provides antibodies, activatable antibodies, multispecific antibodies and/or multispecific activatable antibodies that bind at least the epsilon chain of CD3 (CD3ε). As used herein, an activatable antibody is an antibody that includes a masking moiety (MM) linked to the antigen- or epitope-binding domain of the antibody such that coupling of the MM reduces the ability of the antigen- or epitope-binding domain to bind its target. As used herein, a multispecific antibody is an antibody that recognizes two or more different antigens or epitopes, and a multispecific activatable antibody is a multispecific antibody that includes at least one masking moiety (MM) linked to at least one antigen- or epitope-binding domain of the multispecific antibody such that coupling of the MM reduces the ability of the antigen- or epitope-binding domain to bind its target. The activatable antibodies and/or activatable multispecific antibodies provided herein are stable in circulation, activated at intended sites of therapy and/or diagnosis but not in normal, i.e., healthy tissue, and, when activated, exhibit binding to a target that is at least comparable to the corresponding, unmodified antibody or multispecific antibody.

The antibodies, activated activatable antibodies, multispecific antibodies and/or activated multispecific activatable antibodies of the present disclosure bind to CD3ε with a binding constant ($K_d$) of ≤1 μM, for example, in some embodiments, ≤100 nM, ≤10 nM, or ≤1 nM.

The anti-CD3ε antibodies, activatable antibodies, multispecific antibodies and/or multispecific activatable antibodies of the disclosure serve to activate T cells via engagement of CD3ε on the T cells. That is, such antibodies agonize, stimulate, activate, and/or augment CD3-mediated T cell activation. Biological activities of CD3 include, for example, T cell activation and other signaling through interaction between CD3 and the antigen-binding subunits of the T-Cell Receptor (TCR). For example, the anti-CD3ε antibodies, activated activatable antibodies, multispecific antibodies and/or activated multispecific activatable antibodies completely or partially activate T cells via engagement of CD3ε on T cells by partially or completely modulating, e.g., agonizing, stimulating, activating or otherwise augmenting CD3-mediated T cell activation.

Non-limiting examples of multispecific antibodies include bispecific antibodies, trispecific antibodies, tetraspecific antibodies, and other multispecific antibodies. Multispecific antibodies provided herein are also multivalent; as used herein, multivalency refers to the total number of binding sites on the antibody, regardless of whether the binding sites recognize the same or different antigens or epitopes. Non-limiting examples of multispecific activatable antibodies include bispecific activatable antibodies, trispecific activatable antibodies, tetraspecific activatable antibodies, and other multispecific activatable antibodies. Multispecific activatable antibodies provided herein are also multivalent.

In some embodiments, the multispecific antibodies or fragments thereof and/or multispecific activatable antibodies or fragments thereof are designed to engage T cells and/or other immune effector cells. Multispecific activatable antibodies or fragments thereof that engage T cells are also referred to herein as T-cell engaging multispecific antibodies or fragments thereof and/or T-cell engaging multispecific activatable antibodies or fragments thereof. Multispecific activatable antibodies or fragments thereof that engage immune effector cells are also referred to herein as immune effector cell engaging multispecific antibodies or fragments thereof and/or immune effector cell engaging multispecific activatable antibodies or fragments thereof. In some embodiments, the multispecific antibodies or fragments thereof and/or multispecific activatable antibodies or fragments thereof are designed to bind or otherwise interact with more than one target and/or more than one epitope, also referred to herein as multi-antigen targeting antibodies or fragments thereof and/or multi-antigen targeting activatable antibodies or fragments thereof.

In some embodiments, a multispecific antibody or fragment thereof includes an IgG domain and a scFv domain. In some embodiments, a multispecific antibody or fragment thereof includes an IgG variable domain and a scFv domain. In some embodiments, one antibody domain of a multispecific antibody or fragment thereof has specificity for a target antigen and another antibody domain has specificity for a T-cell surface antigen. In some embodiments, one antibody domain of a multispecific antibody or fragment thereof has specificity for a target antigen and another antibody domain has specificity for another target antigen. In some embodiments, one antibody domain of a multispecific antibody or fragment thereof has specificity for an epitope of a target antigen and another antibody domain has specificity for another epitope of the same target antigen.

In some embodiments, the multispecific activatable antibodies are engineered to include a masking moiety (MM) that is coupled to an antibody or antigen-binding fragment thereof (AB) via a non-cleavable linker. For example, in some embodiments, the multispecific activatable antibody is a T-cell engaging multispecific activatable antibody that includes a targeting antibody or antigen-binding fragment thereof and a T-cell engaging antibody or antigen-binding portion thereof, where the T-cell engaging antibody or antigen-binding fragment thereof includes a first antibody or antigen-binding fragment thereof (AB1) that binds a first, T-cell engaging target, where the AB1 is attached via non-cleavable linker to a masking moiety (MM1) such that coupling of the MM reduces the ability of the AB1 to bind the first target, and the targeting antibody or antigen-binding fragment thereof includes a second antibody or antigen-binding fragment thereof (AB2) that binds a second target, where the AB2 is attached via a cleavable linker to a masking moiety (MM2) such that coupling of the MM reduces the ability of the AB2 to bind the second target.

In some embodiments, the multispecific activatable antibody is a T-cell engaging multispecific activatable antibody that includes a targeting antibody or antigen-binding fragment thereof and a T-cell engaging antibody or antigen-binding portion thereof, where the T-cell engaging antibody or antigen-binding fragment thereof includes a first antibody or antigen-binding fragment thereof (AB1) that binds a first, T-cell engaging target, where the AB1 is attached via non-cleavable linker to a masking moiety (MM1) such that coupling of the MM reduces the ability of the AB1 to bind the first target, and the targeting antibody or antigen-binding fragment thereof is unmasked.

Definitions

Unless otherwise defined, scientific and technical terms used in connection with the present disclosure shall have the meanings that are commonly understood by those of ordinary skill in the art. The term "a" entity or "an" entity refers to one or more of that entity. For example, a compound refers to one or more compounds. As such, the terms "a", "an", "one or more" and "at least one" can be used interchangeably. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well-known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The foregoing techniques and procedures are generally performed according to conventional methods well known in the art and as described in various general and more specific references that are cited and discussed throughout the present specification. See e.g., Sambrook et al. Molecular Cloning: A Laboratory Manual (2d ed., Cold Spring Harbor Laboratory Press, Cold Spring Harbor, N.Y. (1989)). The nomenclatures utilized in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

As utilized in accordance with the present disclosure, the following terms, unless otherwise indicated, shall be understood to have the following meanings:

As used herein, the term "antibody" refers to immunoglobulin molecules and antigen-binding portions of immunoglobulin (Ig) molecules, i.e., molecules that contain an antigen binding site that specifically binds (immunoreacts with) an antigen. By "specifically bind" or "immunoreacts with" or "immunospecifically bind" is meant that the antibody reacts with one or more antigenic determinants of the desired antigen and does not react with other polypeptides or binds at much lower affinity ($K_d > 10^{-6}$). Antibodies include, but are not limited to, polyclonal, monoclonal, chimeric, fully human, domain antibody, single chain, Fab, and F(ab')$_2$ fragments, scFvs, and an Fab expression library.

The basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. In general, antibody molecules obtained from humans relate to any of the classes IgG, IgM, IgA, IgE and IgD, which differ from one another by the nature of the heavy chain present in the molecule. Certain classes have subclasses as well, such as IgG$_1$, IgG$_2$, IgG$_3$, IgG$_4$, and others. Furthermore, in humans, the light chain may be a kappa chain or a lambda chain.

The term "monoclonal antibody" (mAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs contain an antigen binding site capable of immunoreacting with a particular epitope of the antigen characterized by a unique binding affinity for it.

The term "antigen-binding site" or "binding portion" refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains, referred to as "hypervariable regions," are interposed between more conserved flanking stretches known as "framework regions," or "FRs". Thus, the term "FR" refers to amino acid sequences that are naturally found between, and adjacent to, hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs." The assignment of amino acids to each domain is in accordance with the definitions of Kabat Sequences of Proteins of Immunological Interest (National Institutes of Health, Bethesda, Md. (1987 and 1991)), or Chothia & Lesk J. Mol. Biol. 196:901-917 (1987), Chothia et al. Nature 342:878-883 (1989).

As used herein, the term "epitope" includes any protein determinant capable of specific binding to an immunoglobulin, an scFv, or a T-cell receptor. The term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. For example, antibodies may be raised against N-terminal or C-terminal peptides of a polypeptide. An antibody is said to specifically bind an antigen when the dissociation constant is $\leq 1$ µM; for example, in some embodiments $\leq 100$ nM and in some embodiments, $\leq 10$ nM.

As used herein, the terms "specific binding," "immunological binding," and "immunological binding properties" refer to the non-covalent interactions of the type that occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and geometric parameters that equally influence the rate in both directions. Thus, both the "on rate constant" ($K_{on}$) and the "off rate constant" ($K_{off}$) can be determined by calculation of the concentrations and the actual rates of association and dissociation. (See Nature 361:186-87 (1993)). The ratio of $K_{off}/K_{on}$ enables the cancellation of all parameters not related to affinity, and is equal to the dissociation constant $K_d$. (See, generally, Davies et al. (1990) Annual Rev Biochem 59:439-473). An antibody of the present disclosure is said to specifically bind to EGFR, when the binding constant ($K_d$) is µM, for example in some embodiments $\leq 100$ nM, in some embodiments $\leq 10$ nM, and in some embodiments $\leq 100$ pM to about 1 pM, as measured by assays such as radioligand binding assays or similar assays known to those skilled in the art.

The term "isolated polynucleotide" as used herein shall mean a polynucleotide of genomic, cDNA, or synthetic origin or some combination thereof, which by virtue of its origin the "isolated polynucleotide" (1) is not associated with all or a portion of a polynucleotide in which the "isolated polynucleotide" is found in nature, (2) is operably linked to a polynucleotide that it is not linked to in nature, or (3) does not occur in nature as part of a larger sequence. Polynucleotides in accordance with the disclosure include the nucleic acid molecules encoding the heavy chain immunoglobulin molecules shown herein, and nucleic acid molecules encoding the light chain immunoglobulin molecules shown herein.

The term "isolated protein" referred to herein means a protein of cDNA, recombinant RNA, or synthetic origin or some combination thereof, which by virtue of its origin, or source of derivation, the "isolated protein" (1) is not associated with proteins found in nature, (2) is free of other proteins from the same source, e.g., free of murine proteins, (3) is expressed by a cell from a different species, or (4) does not occur in nature.

The term "polypeptide" is used herein as a generic term to refer to native protein, fragments, or analogs of a polypeptide sequence. Hence, native protein fragments, and analogs are species of the polypeptide genus. Polypeptides in accordance with the disclosure comprise the heavy chain immunoglobulin molecules shown herein, and the light chain immunoglobulin molecules shown herein, as well as antibody molecules formed by combinations comprising the heavy chain immunoglobulin molecules with light chain immunoglobulin molecules, such as kappa light chain immunoglobulin molecules, and vice versa, as well as fragments and analogs thereof.

The term "naturally-occurring" as used herein as applied to an object refers to the fact that an object can be found in nature. For example, a polypeptide or polynucleotide sequence that is present in an organism (including viruses) that can be isolated from a source in nature and that has not been intentionally modified by man in the laboratory or otherwise is naturally-occurring.

The term "operably linked" as used herein refers to positions of components so described are in a relationship permitting them to function in their intended manner. A control sequence "operably linked" to a coding sequence is ligated in such a way that expression of the coding sequence is achieved under conditions compatible with the control sequences.

The term "control sequence" as used herein refers to polynucleotide sequences that are necessary to effect the expression and processing of coding sequences to which they are ligated. The nature of such control sequences differs depending upon the host organism in prokaryotes, such control sequences generally include promoter, ribosomal binding site, and transcription termination sequence in eukaryotes, generally, such control sequences include promoters and transcription termination sequence. The term "control sequences" is intended to include, at a minimum, all components whose presence is essential for expression and processing, and can also include additional components whose presence is advantageous, for example, leader sequences and fusion partner sequences. The term "polynucleotide" as referred to herein means nucleotides of at least 10 bases in length, either ribonucleotides or deoxynucleotides or a modified form of either type of nucleotide. The term includes single and double stranded forms of DNA.

The term oligonucleotide referred to herein includes naturally occurring, and modified nucleotides linked together by naturally occurring, and non-naturally occurring oligonucleotide linkages. Oligonucleotides are a polynucleotide subset generally comprising a length of 200 bases or fewer. In some embodiments, oligonucleotides are 10 to 60 bases in length, for example in some embodiments, 12, 13, 14, 15, 16, 17, 18, 19, or 20 to 40 bases in length. Oligonucleotides are usually single stranded, e.g., for probes, although oligonucleotides may be double stranded, e.g., for use in the construction of a gene mutant. Oligonucleotides of the disclosure are either sense or antisense oligonucleotides.

The term "naturally occurring nucleotides" referred to herein includes deoxyribonucleotides and ribonucleotides. The term "modified nucleotides" referred to herein includes nucleotides with modified or substituted sugar groups and the like. The term "oligonucleotide linkages" referred to herein includes oligonucleotide linkages such as phosphorothioate, phosphorodithioate, phosphoroselerloate, phosphorodiselenoate, phosphoroanilothioate, phoshoraniladate, phosphoronmidate, and the like. See e.g., LaPlanche et al. Nucl. Acids Res. 14:9081 (1986); Stec et al. J. Am. Chem. Soc. 106:6077 (1984), Stein et al. Nucl. Acids Res. 16:3209 (1988), Zon et al. Anti Cancer Drug Design 6:539 (1991); Zon et al. Oligonucleotides and Analogues: A Practical Approach, pp. 87-108 (F. Eckstein, Ed., Oxford University Press, Oxford England (1991)); Stec et al. U.S. Pat. No. 5,151,510; Uhlmann and Peyman Chemical Reviews 90:543 (1990). An oligonucleotide can include a label for detection, if desired.

As used herein, the twenty conventional amino acids and their abbreviations follow conventional usage. See Immunology—A Synthesis (2nd Edition, E. S. Golub and D. R. Gren, Eds., Sinauer Associates, Sunderland? Mass. (1991)). Stereoisomers (e.g., D-amino acids) of the twenty conventional amino acids, unnatural amino acids such as α-, α-disubstituted amino acids, N-alkyl amino acids, lactic acid, and other unconventional amino acids may also be suitable components for polypeptides of the present disclosure. Examples of unconventional amino acids include: 4 hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxy-terminal direction, in accordance with standard usage and convention.

Similarly, unless specified otherwise, the left-hand end of single-stranded polynucleotide sequences is the 5' end the left-hand direction of double-stranded polynucleotide sequences is referred to as the 5' direction. The direction of 5' to 3' addition of nascent RNA transcripts is referred to as the transcription direction sequence regions on the DNA strand having the same sequence as the RNA and that are 5' to the 5' end of the RNA transcript are referred to as "upstream sequences", sequence regions on the DNA strand having the same sequence as the RNA and that are 3' to the 3' end of the RNA transcript are referred to as "downstream sequences".

As applied to polypeptides, the term "substantial identity" means that two peptide sequences, when optimally aligned, such as by the programs GAP or BESTFIT using default gap weights, share at least 80 percent sequence identity, for example in some embodiments, at least 90 percent sequence identity, in some embodiments at least 95 percent sequence identity, and in some embodiments at least 99 percent sequence identity.

In some embodiments, residue positions that are not identical differ by conservative amino acid substitutions.

As discussed herein, minor variations in the amino acid sequences of antibodies or immunoglobulin molecules are contemplated as being encompassed by the present disclosure, providing that the variations in the amino acid sequence maintain at least 75%, for example in some embodiments at least 80%, 90%, 95%, and in some embodiments 99%. In particular, conservative amino acid replacements are contemplated. Conservative replacements are those that take place within a family of amino acids that are related in their side chains. Genetically encoded amino acids are generally divided into families: (1) acidic amino acids are aspartate, glutamate; (2) basic amino acids are lysine, arginine, histidine; (3) non-polar amino acids are alanine, valine, leucine, isoleucine, proline, phenylalanine, methionine, tryptophan, and (4) uncharged polar amino acids are glycine, asparagine, glutamine, cysteine, serine, threonine, tyrosine. The hydrophilic amino acids include arginine, asparagine, aspartate, glutamine, glutamate, histidine, lysine, serine, and threonine. The hydrophobic amino acids include alanine, cysteine, isoleucine, leucine, methionine, phenylalanine, proline, tryptophan, tyrosine and valine. Other families of amino acids include (i) serine and threonine, which are the aliphatic-hydroxy family; (ii) asparagine and glutamine, which are the amide containing family; (iii) alanine, valine, leucine and isoleucine, which are the aliphatic family; and (iv) phenylalanine, tryptophan, and tyrosine, which are the aromatic family. For example, it is reasonable to expect that an isolated replacement of a leucine with an isoleucine or valine, an aspartate with a glutamate, a threonine with a serine, or a similar replacement of an amino acid with a structurally related amino acid will not have a major effect on the binding or properties of the resulting molecule, especially if the replacement does not involve an amino acid within a framework site. Whether an amino acid change results in a functional peptide can readily be determined by assaying the specific activity of the polypeptide derivative. Assays are described in detail herein. Fragments or analogs of antibodies or immunoglobulin molecules can be readily prepared by those of ordinary skill in the art. In some embodiments, amino- and carboxy-termini of fragments or analogs occur near boundaries of functional domains. Structural and functional domains can be identified by comparison of the nucleotide and/or amino acid sequence data to public or proprietary sequence databases. Computerized comparison methods are used to identify sequence motifs or predicted protein conformation domains that occur in other proteins of known structure and/or function. Methods to identify protein sequences that fold into a known three-dimensional structure are known. Bowie et al. Science 253:164 (1991). Thus, the foregoing examples demonstrate that those of skill in the art can recognize sequence motifs and structural conformations that may be used to define structural and functional domains in accordance with the disclosure.

In some embodiments, amino acid substitutions are those that: (1) reduce susceptibility to proteolysis, (2) reduce susceptibility to oxidation, (3) alter binding affinity for forming protein complexes, (4) alter binding affinities, and (4) confer or modify other physicochemical or functional properties of such analogs. Analogs can include various muteins of a sequence other than the naturally-occurring peptide sequence. For example, single or multiple amino acid substitutions (for example, conservative amino acid substitutions) may be made in the naturally-occurring sequence (for example, in the portion of the polypeptide outside the domain(s) forming intermolecular contacts. A conservative amino acid substitution should not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et at. Nature 354:105 (1991).

The term "polypeptide fragment" as used herein refers to a polypeptide that has an amino terminal and/or carboxy-terminal deletion and/or one or more internal deletion(s), but where the remaining amino acid sequence is identical to the corresponding positions in the naturally-occurring sequence deduced, for example, from a full length cDNA sequence. Fragments typically are at least 5, 6, 8 or 10 amino acids long, for example in some embodiments at least 14 amino acids long, in some embodiments at least 20 amino acids long, usually at least 50 amino acids long, and in some embodiments at least 70 amino acids long. The term "analog" as used herein refers to polypeptides that are comprised of a segment of at least 25 amino acids that has substantial identity to a portion of a deduced amino acid sequence and that has specific binding to EGFR, under suitable binding conditions. Typically, polypeptide analogs comprise a conservative amino acid substitution (or addition or deletion) with respect to the naturally-occurring sequence. Analogs typically are at least 20 amino acids long, for example in some embodiments at least 50 amino acids long or longer, and can often be as long as a full-length naturally-occurring polypeptide.

The term "agent" is used herein to denote a chemical compound, a mixture of chemical compounds, a biological macromolecule, or an extract made from biological materials.

As used herein, the terms "label" or "labeled" refers to incorporation of a detectable marker, e.g., by incorporation of a radiolabeled amino acid or attachment to a polypeptide of biotinyl moieties that can be detected by marked avidin (e.g., streptavidin containing a fluorescent marker or enzymatic activity that can be detected by optical or calorimetric methods). In certain situations, the label or marker can also be therapeutic. Various methods of labeling polypeptides and glycoproteins are known in the art and may be used. Examples of labels for polypeptides include, but are not limited to, the following: radioisotopes or radionuclides (e.g., $^{3}H$, $^{14}C$, $^{15}N$, $^{35}S$, $^{90}Y$, $^{99}Tc$, $^{111}In$ $^{125}I$ $^{131}I$), fluorescent labels (e.g., a fluorophore, rhodamine, lanthanide phosphors), enzymatic labels (e.g., horseradish peroxidase, p-galactosidase, luciferase, alkaline phosphatase), chemiluminescent, biotinyl groups, predetermined polypeptide epitopes recognized by a secondary reporter (e.g., leucine zipper pair sequences, binding sites for secondary antibodies, metal binding domains, epitope tags). In some embodiments, labels are attached by spacer arms of various lengths to reduce potential steric hindrance. The term "pharmaceutical agent or drug" as used herein refers to a chemical compound or composition capable of inducing a desired therapeutic effect when properly administered to a patient.

As used herein, "substantially pure" means an object species is the predominant species present (i.e., on a molar basis it is more abundant than any other individual species in the composition), and a substantially purified fraction is a composition wherein the object species comprises at least about 50 percent (on a molar basis) of all macromolecular species present.

Generally, a substantially pure composition will comprise more than about 80 percent of all macromolecular species present in the composition, for example, in some embodiments, more than about 85%, 90%, 95%, and 99%. In some embodiments, the object species is purified to essential homogeneity (contaminant species cannot be detected in the composition by conventional detection methods) wherein the composition consists essentially of a single macromolecular species.

The term patient includes human and veterinary subjects.

Other chemistry terms herein are used according to conventional usage in the art, as exemplified by The McGraw-Hill Dictionary of Chemical Terms (Parker, S., Ed., McGraw-Hill, San Francisco (1985)).

Multispecific Antibodies and Multispecific Activatable Antibodies

Exemplary multi specific antibodies and/or multi specific activatable antibodies of the disclosure include, for example, those shown in the Examples provided herein, and variants thereof.

In some non-limiting embodiments, at least one of the AB in the multispecific antibody is specific for CD3ε and at least one other AB is a binding partner for any target listed in Table 1.

TABLE 1

| Exemplary Targets | | | | | |
|---|---|---|---|---|---|
| 1-92-LFA-3 | CD52 | DL44 | HVEM | LAG-3 | STEAP1 |
| Alpha-4 integrin | CD56 | DLK1 | Hyaluronidase | LIF-R | STEAP2 |
| Alpha-V integrin | CD64 | DLL4 | ICOS | Lewis X | TAG-72 |
| alpha4beta1 integrin | CD70 | DPP-4 | IFNalpha | LIGHT | TAPA1 |
| alpha4beta7 integrin | CD71 | DSG1 | IFNbeta | LRP4 | TGFbeta |
| AGR2 | CD74 | EGFR | IFNgamma | LRRC26 | TIGIT |
| Anti-Lewis-Y | | EGFRviii | IgE | MCSP | TIM-3 |
| Apelin J receptor | CD80 | Endothelin B receptor (ETBR) | IgE Receptor (FceRI) | Mesothelin | TLR2 |
| APRIL | CD81 | ENPP3 | IGF | MRP4 | TLR4 |

TABLE 1-continued

Exemplary Targets

| | | | | | |
|---|---|---|---|---|---|
| B7-H4 | CD86 | EpCAM | IGF1R | MUC1 | TLR6 |
| BAFF | CD95 | EPHA2 | IL1B | Mucin-16 (MUC16, CA-125) | TLR7 |
| BTLA | CD117 | EPHB2 | IL1R | Na/K ATPase | TLR8 |
| C5 complement | CD125 | ERBB3 | IL2 | Neutrophil elastase | TLR9 |
| C-242 | CD132 (IL-2RG) | F protein of RSV | IL11 | NGF | TMEM31 |
| CA9 | CD133 | FAP | IL12 | Nicastrin | TNFalpha |
| CA19-9 (Lewis a) | CD137 | FGF-2 | IL12p40 | Notch Receptors | TNFR |
| Carbonic anhydrase 9 | CD138 | FGF8 | IL-12R, IL-12Rbeta1 | Notch 1 | TNFRS12A |
| CD2 | CD166 | FGFR1 | IL13 | Notch 2 | TRAIL-R1 |
| CD3 | CD172A | FGFR2 | IL13R | Notch 3 | TRAIL-R2 |
| CD6 | CD248 | FGFR3 | IL15 | Notch 4 | Transferrin |
| CD9 | CDH6 | FGFR4 | IL17 | NOV | Transferrin receptor |
| CD11a | CEACAM5 (CEA) | Folate receptor | IL18 | OSM-R | TRK-A |
| CD19 | CEACAM6 (NCA-90) | GAL3ST1 | IL21 | OX-40 | TRK-B |
| CD20 | CLAUDIN-3 | G-CSF | IL23 | PAR2 | uPAR |
| CD22 | CLAUDIN-4 | G-CSFR | IL23R | PDGF-AA | VAP1 |
| CD24 | cMet | GD2 | IL27/IL27R (wsx1) | PDGF-BB | VCAM-1 |
| CD25 | Collagen | GITR | IL29 | PDGFralpha | VEGF |
| CD27 | Cripto | GLUT1 | IL-31R | PDGFRbeta | VEGF-A |
| CD28 | CSFR | GLUT4 | IL31/IL31R | PD-1 | VEGF-B |
| CD30 | CSFR-1 | GM-CSF | IL2R | PD-L1 | VEGF-C |
| CD33 | CTLA-4 | GM-CSFR | IL4 | PD-L2 | VEGF-D |
| CD38 | CTGF | GP IIb/IIIa receptors | IL4R | Phosphatidyl-serine | VEGFR1 |
| CD40 | CXCL10 | Gp130 | IL6, IL6R | P1GF | VEGFR2 |
| CD40 | CXCL13 | GPIIB/IIIA | Insulin Receptor | PSCA | VEGFR3 |
| CD41 | CXCR1 | GPNMB | Jagged Ligands | PSMA | VISTA |
| CD44 | CXCR2 | GRP78 | Jagged 1 | RAAG12 | WISP-1 |
| CD44v6 | | HER2/neu | Jagged 2 | RAGE | WISP-2 |
| CD47 | CXCR4 | HGF | | SLC44A4 | WISP-3 |
| CD51 | CYR61 | hGH | | Sphingosine 1 Phosphate | |

In some non-limiting embodiments, at least one of the AB of the multispecific antibody is or is derived from a sequence set forth in the Examples provided herein.

In some non-limiting embodiments, at least one of the AB of the multispecific antibody is or is derived from an antibody listed in Table 2.

TABLE 2

Exemplary sources for ABs

| Antibody Trade Name (antibody name) | Target |
|---|---|
| Avastin ™ (bevacizumab) | VEGF |
| Lucentis ™ (ranibizumab) | VEGF |
| Erbitux ™ (cetuximab) | EGFR |
| Vectibix ™ (panitumumab) | EGFR |
| Remicade ™ (infliximab) | TNFα |
| Humira ™ (adalimumab) | TNFα |
| Tysabri ™ (natalizumab) | Integrinα4 |
| Simulect ™ (basiliximab) | IL2R |
| Soliris ™ (eculizumab) | Complement C5 |
| Raptiva ™ (efalizumab) | CD11a |
| Bexxar ™ (tositumomab) | CD20 |
| Zevalin ™ (ibritumomab tiuxetan) | CD20 |
| Rituxan ™ (rituximab) | CD20 |
| Ocrelizumab | CD20 |
| Arzerra ™ (ofatumumab) | CD20 |
| Obinutuzumab | CD20 |

TABLE 2-continued

Exemplary sources for ABs

| Antibody Trade Name (antibody name) | Target |
|---|---|
| Zenapax ™ (daclizumab) | CD25 |
| Adcetris ™ (brentuximab vedotin) | CD30 |
| Myelotarg ™ (gemtuzumab) | CD33 |
| Mylotarg ™ (gemtuzumab ozogamicin) | CD33 |
| Campath ™ (alemtuzumab) | CD52 |
| ReoPro ™ (abiciximab) | Glycoprotein receptor IIb/IIIa |
| Xolair ™ (omalizumab) | IgE |
| Herceptin ™ (trastuzumab) | Her2 |
| Kadcyla ™ (trastuzumab emtansine) | Her2 |
| Synagis ™ (palivizumab) | F protein of RSV |
| Yervoy ™ (ipilimumab) | CTLA-4 |
| (tremelimumab) | CTLA-4 |
| Hu5c8 | CD40L |
| (pertuzumab) | Her2-neu |
| (ertumaxomab) | CD3/Her2-neu |
| Orencia ™ (abatacept) | CTLA-4 |
| (tanezumab) | NGF |
| (bavituximab) | Phosphatidylserine |
| (zalutumumab) | EGFR |
| (mapatumumab) | EGFR |
| (matuzumab) | EGFR |
| (nimotuzumab) | EGFR |
| ICR62 | EGFR |
| mAb 528 | EGFR |

TABLE 2-continued

Exemplary sources for ABs

| Antibody Trade Name (antibody name) | Target |
|---|---|
| CH806 | EGFR |
| MDX-447 | EGFR/CD64 |
| (edrecolomab) | EpCAM |
| RAV12 | RAAG12 |
| huJ591 | PSMA |
| Enbrel ™ (etanercept) | TNF-R |
| Amevive ™ (alefacept) | 1-92-LFA-3 |
| Antril ™, Kineret ™ (ankinra) | IL-1Ra |
| GC1008 | TGFbeta |
|  | Notch, e.g., Notch 1 |
|  | Jagged 1 or Jagged 2 |
| (adecatumumab) | EpCAM |
| (figitumumab) | IGF1R |
| (tocilizumab) | IL-6 receptor |
| Stelara ™ (ustekinumab) | IL-12/IL-23 |
| Prolia ™ (denosumab) | RANKL |
| Keytruda (Pembrolizumab) | PD-1 |
| Opdivo (Nivolumab) | PD-1 |
| Atezolizumab (MPDL3280A) | PD-L1 |

Exemplary antibodies, activatable antibodies and antigen-binding fragments thereof that bind CD3ε of the disclosure include the CD3ε binding sequences described in the Examples, for example in Examples 2 and 4. Exemplary multispecific antibodies and multispecific activatable antibodies include the multispecific antibodies and multispecific activatable antibodies described in the Examples, for example in Example 4.

In some embodiments, the multispecific activatable antibody includes a heavy chain sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, and 546.

In some embodiments, the multispecific activatable antibody includes a light chain sequence selected from the group consisting of SEQ ID NOs: 448, 450, 458, 468, 474, 482, 484, 508, 516, and 520.

In some embodiments, the multispecific activatable antibody includes a heavy chain sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, and 546; and a light chain sequence selected from the group consisting of SEQ ID NOs: 448, 450, 458, 468, 474, 482, 484, 508, 516, and 520.

In some embodiments, the multispecific activatable antibody includes a heavy chain sequence that is at least 90%, 91%, 92%, 93%, 94%, 95%, 96%, 97%, 98% or 99% identical to an amino acid sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, and 546.

In some embodiments, the multispecific activatable antibody includes a light chain sequence that is at least 90%, 91%, 92%, 93%, 94%, 95%, 96%, 97%, 98% or 99% identical to an amino acid sequence selected from the group consisting of SEQ ID NOs: 448, 450, 458, 468, 474, 482, 484, 508, 516, and 520.

In some embodiments, the multispecific activatable antibody includes a heavy chain sequence that is at least 90%, 91%, 92%, 93%, 94%, 95%, 96%, 97%, 98% or 99% identical to an amino acid sequence selected from the group consisting of SEQ ID NOs: 446, 452, 454, 456, 460, 462, 464, 466, 470, 472, 476, 478, 480, 486, 488, 490, 492, 494, 496, 498, 500, 502, 504, 510, 512, 514, 518, 524, 526, 530, 532, 534, 536, 538, 540, 542, 544, and 546; and a light chain sequence that is at least 90%, 91%, 92%, 93%, 94%, 95%, 96%, 97%, 98% or 99% identical to an amino acid sequence selected from the group consisting of SEQ ID NOs: 448, 450, 458, 468, 474, 482, 484, 508, 516, and 520.

In some embodiments, the multispecific activatable antibody includes the amino acid sequence of SEQ ID NO: 506. In some embodiments, the multispecific activatable antibody includes an amino acid sequence that is at least 90%, 91%, 92%, 93%, 94%, 95%, 96%, 97%, 98% or 99% identical to the amino acid sequence of SEQ ID NO: 506.

Exemplary ABs that bind CD3ε of the disclosure include the CD3ε binding sequences shown below:

CD3HvLv (SEQ ID NO: 587)
EVQLVESGGGLVQPGGSLKLSCAASGFTFNKYAMNWVRQAPGKGLEWVAR

IRSKYNNYATYYADSVKDRFTISRDDSKNTAYLQMNNLKTEDTAVYYCVR

HGNFGNSYISYWAYWGQGTLVTVSSGGGGSGGGGSGGGGSQTVVTQEPSL

TVSPGGTVTLTCGSSTGAVTSGYYPNWVQQKPGQAPRGLIGGTKFLAPGT

PARFSGSLLGGKAALTLSGVQPEDEAEYYCALWYSNRWVFGGGTKLTVL

CD3HvLv (SEQ ID NO: 588)
QTVVTQEPSLTVSPGGTVTLTCRSSTGAVTTSNYANWVQQKPGQAPRGLI

GGTNKRAPGTPARFSGSLLGGKAALTLSGVQPEDEAEYYCALWYSNLWVF

GGGTKLTVLGGGGSGGGGSGGGGSEVQLVESGGGLVQPGGSLKLSCAASG

FTFNTYAMNWVRQAPGKGLEWVARIRSKYNNYATYYADSVKDRFTISRDD

SKNTAYLQMNNLKTEDTAVYYCVRHGNFGNSYVSWFAYWGQGTLVTVSS

In some embodiments, the activatable anti-CD3ε antibody includes a heavy chain that comprises or is derived from a heavy chain amino acid sequence shown in Table 17. In some embodiments, the activatable anti-CD3ε antibody includes a light chain that comprises or is derived from a light chain amino acid sequence shown in Table 17. In some embodiments, the activatable anti-CD3ε antibody includes a heavy chain that comprises or is derived from a heavy chain amino acid sequence shown in Table 17, and a light chain that comprises or is derived from a light chain amino acid sequence shown in Table 17. In some embodiments, the activatable anti-CD3ε antibody includes a combination of a heavy chain variable region sequence and a light chain variable region sequence from the combinations shown in Group A in Table 17. In some embodiments, the activatable anti-CD3ε antibody includes a combination of a heavy chain variable region sequence and a light chain variable region sequence from the combinations shown in Group B in Table 17. In some embodiments, the activatable anti-CD3ε antibody includes a combination of a heavy chain variable region sequence and a light chain variable region sequence from the combinations shown in Group C in Table 17. In some embodiments, the activatable anti-CD3ε antibody includes a combination of a heavy chain variable region sequence and a light chain variable region sequence from the combinations shown in Group D in Table 17. In some embodiments, the activatable anti-CD3ε antibody includes a combination of a heavy chain variable region sequence and a light chain variable region sequence from the combinations shown in Group E in Table 17. In some embodiments, the activatable anti-CD3ε antibody includes a combination of a heavy chain variable region sequence and a light chain variable region sequence from the combinations shown in Group F in Table 17. In some embodiments, the activatable anti-CD3ε antibody includes a combination of a heavy chain variable region sequence and a light chain variable region sequence from the combinations shown in Group G in Table 17. In some embodiments, the activatable anti-CD3ε antibody includes a combination of a heavy chain variable region sequence and a light chain variable region sequence from the combinations shown in Group H in Table 17. In some embodiments, the activatable anti-CD3ε antibody includes a combination of a heavy chain variable region sequence and a light chain variable region sequence from the combinations shown in Group I in Table 17. In some embodiments, the activatable anti-CD3ε antibody includes a combination of a heavy chain variable region sequence and a light chain variable region sequence from the combinations shown in Group J in Table 17. In some embodiments, the activatable anti-CD3ε antibody includes a combination of a heavy chain variable region sequence and a light chain variable region sequence from the combinations shown in Group K in Table 17. In some embodiments, the activatable anti-CD3ε antibody includes a combination of a heavy chain variable region sequence and a light chain variable region sequence from the combinations shown in Group L in Table 17. In some embodiments, the activatable anti-CD3ε antibody includes a combination of a heavy chain variable region sequence and a light chain variable region sequence from the combinations shown in Group M in Table 17. In some embodiments, the activatable anti-CD3ε antibody includes a combination of a heavy chain variable region sequence and a light chain variable region sequence from the combinations shown in Group N in Table 17. In some embodiments, the activatable anti-CD3ε antibody includes a combination of a heavy chain variable region sequence and a light chain variable region sequence from the combinations shown in Group O in Table 17. In some embodiments, the activatable anti-CD3ε antibody includes a combination of a heavy chain variable region sequence and a light chain variable region sequence from the combinations shown in Group P in Table 17. In some embodiments, the activatable anti-CD3ε antibody includes a combination of a heavy chain variable region sequence and a light chain variable region sequence from the combinations shown in Group Q in Table 17.

TABLE 17

Variable Heavy Chain Region (VH) and Variable Light Chain Region (VL) Sequences for Activatable Antibodies that Bind CDR

Group A

VH QIVLTQSPAIMSASPGEKVTMTCSASSSVSYMNWYQQKSGTSPKRWIYDTSKLASGVPAHFRGSGSGTSYSL
TISGMEAEDAATYYCQQWSSNPFT (SEQ ID NO: 589)

VH QVQLQQSGAELARPGASVKMSCKASGYTFTRYTMHWVKQRPGQGLEWIGYINPSRGYTNYNQKFKDKATLTT
DKSSSTAYMQLSSLTSEDSAVYYCARYYDDHYCLDYWGQG (SEQ ID NO: 590)

VH QVQLVQSGGGVVQPGRSLRLSCKASGYTFTRYTMHWVRQAPGKGLEWIGYINPSRGYTNYNQKFKDRFTIST
DKSKSTAFLQMDSLRPEDTAVYYCARYYDDHYCLDYWGQGTPVTVSS (SEQ ID NO: 591)

VH QVQLVESGGGVVQPGRSLRLSCSSSGYTFTRYTMHWVRQAPGKGLEWVAYINPSRGYTNYNQKFKDRFTISR
DNSKNTLFLQMDSLRPEDTGVYFCARYYDDHYCLDYWGQGTPVTVSS (SEQ ID NO: 592)

VL DIQMTQSPSSLSASVGDRVTITCSASSSVSYMNWYQQTPGKAPKRWIYDTSKLASGVPSRFSGSGSGTDYTF
TISSLQPEDIATYYCQQWSSNPFT (SEQ ID NO: 593)

VL QIVMTQSPSSLSASVGDRVTITCSASSSVSYMNWYQQTPGKAPKRWIYDTSKLASGVPSRFSGSGSGTDYTF

VL DIQMTQSPSSLSASVGDRVTITCSASSSVSYMNWYQQTPGKAPKLLIYDTSKLASGVPSRFSGSGSGTDYTF
TISSLQPEDIATYYCQQWSSNPFTFGQGTKLQITR (SEQ ID NO: 595)

Group B

VH QVQLQQSGAELARPGASVKMSCKASGYTFTRYTMHWVKQRPGQGLEWIGYINPSRGYTNYNQKFKDKATLTT
DKSSSTAYMQLSSLTSEDSAVYYCARYYDDHYCLDYWGQGTTLTVSS (SEQ ID NO: 596)

VH EVQLVESGGGLVQPGKSLKLSCEASGFTFSGYGMHWVRQAPGRGLESVAYITSSSINIKYADAVKGRFTVSR
DNAKNLLFLQMNILKSEDTAMYYCARFDWDKNYWGQGTMVTVSS (SEQ ID NO: 597)

VL QIVLTQSPAIMSASPGEKVTMTCRASSSVSYMNWYQQKSGTSPKRWIYDTSKVASGVPYRFSGSGSGTSYSL
TISSMEAEDAATYYCQQWSSNPLTFGSGTKLEINR (SEQ ID NO: 598)

VL QIVLTQSPAIMSASPGEKVTMTCSASSSVSYMNWYQQKSGTSPKRWIYDTSKLASGVPAHFRGSGSGTSYSL
TISGMEAEDAATYYCQQWSSNPFTFGSGTKLEINR (SEQ ID NO: 599)

VL DIQMTQSPSSLPASLGDRVTINCQASQDISNYLNWYQQKPGKAPKLLIYYTNKLADGVPSRFSGSGSGRDSS
FTISSLESEDIGSYYCQQYYNYPWTFGPGTKLEIKR (SEQ ID NO: 600)

Group C

VH MGWSWIFLFLLSGTAGVHSQVQLVQSGAEVKKPGASVKVSCKASGYTFISYTMHWVRQAPGQGLEWMGYINP
RSGYTHYNQKLKDKATLTADKSASTAYMELSSLRSEDTAVYYCARSAYYDYDGFAYWGQGTLVTVSS
(SEQ ID NO: 601)

TABLE 17 -continued

Variable Heavy Chain Region (VH) and Variable Light Chain Region (VL) Sequences for Activatable Antibodies that Bind CDR VL METDTLLLWVLLLWVPGSTGDIQMTQSPSSLSASVGDRVTITCSASSSVSYMNWYQQKPGKAPKRLIYDTSK
LASGVPSRFSGSGSGTDFTLTISSLQPEDFATYYCQQWSSNPPTFGGGTKVEIK (SEQ ID NO: 602)

Group D

VH EVQLVESGGGLVQPGGSLRLSCAASGYSFTGYTMNWVRQAPGKGLEWVALINPYKGVSTYNQKFKDRFTISV
DKSKNTAYLQMNSLRAEDTAVYYCARSGYYGDSDWYFDVWGQGTLVTVSS (SEQ ID NO: 603)

VL DIQMTQSPSSLSASVGDRVTITCRASQDIRNYLNWYQQKPGKAPKLLIYYTSRLESGVPSRFSGSGSGTDYT
LTISSLQPEDFATYYCQQGNTLPWTFGQGTKVEIK (SEQ ID NO: 604)
MGWSCIILFLVATATGVHSEVQLVESGGGLVQPGGSLRLSCATSGYTFTEYTMHWMRQAPGKGLEWVAGINP

HC KNGGTSHNQRFMDRFTISVDKSTSTAYMQMNSLRAEDTAVYYCARWRGLNYGFDVRYFDVWGQGTLVTVSSA
STKGPSVFPLAPCSRSTSESTAALGCLVKDYFPEPVTVSWNSGALTSGVHTFPAVLQSSGLYSLSSVVTVTS
SNFGTQTYTCNVDHKPSNTKVDKTVERKCCVECPPCPAPPVAGPSVFLFPPKPKDTLMISRTPEVTCVVVDV
SHEDPEVQFNWYVDGMEVHNAKTKPREEQFNSTFRVVSVLTVVHQDWLNGKEYKCKVSNKGLPAPIEKTISK
TKGQPREPQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGK (SEQ ID NO: 605)

HC EVQLVESGGGLVQPGGSLRLSCATSGYTFTEYTMHWMRQAPGKGLEWVAGINPKNGGTSYADSVKGRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 606)

HC EVQLVESGGGLVQPGGSLRLSCATSGYTFTEYTMHWMRQAPGKGLEWVAGINPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 607)

HC EVQLVESGGGLVQPGGSLRLSCATSGYTFTEYTMHWMRQAPGKGLEWVAGINPKNGGTSHNQRFMDRFTLAV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 608)

HC EVQLVESGGGLVQPGGSLRLSCATSGYTFTEYTMHWMRQAPGKGLEWVAGINPKNGGTSHNQRFMDRFTISV
DKSTSTAYMQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 609)

HC EVQLVESGGGLVQPGGSLRLSCATSGYTFTEYTMHWMRQAPGKGLEWVAGINPKNGGTSHNQRFMDRFTISV
DKSTSTAYMQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHTCPP (SEQ ID NO: 610)

HC EVQLVESGGGLVQPGGSLRLSCATSGYTFTEYTMHWMRQAPGKGLEWVAGINPKNGGTSHNQRFMDRFTISV
DKSKNTLYMELRSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 611)

HC EVQLVESGGGLVQPGGSLRLSCATSGYTFTEYTMHWMRQAPGKGLEWVAGINPKNGGTSHNQRFMDRFTISV
DKSKNTLYLQMNSLTSEDSGIYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 612)

HC EVQLVESGGGLVQPGGSLRLSCATSGYTFTEYTMHWMRQAPGKGLEWVAGINPKNGGTSHNQRFMDRFTISV
DKSKNTLYLQMNSLRAEDTAVYYCARWRGLNYGFDVRYFDVWGAGTTVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 613)

HC EVQLQQSGPELVQPGGSLRLSCATSGYTFTEYTMHWMRQAPGKGLEWVAGINPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 614)

HC EVQLVESGGGLVKPGASLRLSCATSGYTFTEYTMHWMRQAPGKGLEWVAGINPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 615)

HC EVQLVESGGGLVQPGGSLKISCKTSGYTFTEYTMHWMRQAPGKGLEWVAGINPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 616)

HC EVQLVESGGGLVQPGGSLRLSCATSGYTFTEYTMHWMKQSHGKSLEWVAGINPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG

TABLE 17 -continued

Variable Heavy Chain Region (VH) and Variable Light Chain Region
(VL) Sequences for Activatable Antibodies that Bind CDR GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 617)

HC EVQLVESGGGLVQPGGSLRLSCATSGYTFTEYTMHWMRQAPGKGLEWIGGFNPKNGGTSHNQRFMDRFTISV
DKSKNTLYLQMNSLRAEDTAVYYCARWRGLNYGFDVRYFDVWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKPSNT
KVDKKVEPKSCDKTHT (SEQ ID NO: 618)

LC MGWSCIILFLVATATGVHSDIQMTQSPSSLSASVGDRVTITCRASQDINNYLNWYQQKPGKAPKLLIYYTST
LHSGVPSRFSGSGSGTDYTLTISSLQPEDFATYYCQQGNTLPPTFGQGTKVEIKRTVAAPSVFIFPPSDEQL
KSGTASVVCLLNNFYPREAKVQWKVDNALQSGNSQESVTEQDSKDSTYSLSSTLTLSKADYEKHKVYACEVT
HQGLSSPVTKSFNRGEC (SEQ ID NO: 619)

LC DIQMTQSPSSLSASVGDRVTITCRASQDINNYLNWYQQKPGKAPKLLIYYTSTLESGVPSRFSGSGSGTDYT
LTISSLQPEDFATYYCQQGNTLPPTFGQGTKVEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 620)

LC DIQMTQSPSSLSASVGDRVTITCRASQDINNYLNWYQQKPGKAPKLLIYYTSTLHSGVPSRFSGSGSGTDYT
LTISSLQPEDFATYYCQQGNTLPPTFGQGTKVEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 621)

Group E

HC MERHWIFLLLLSVTAGVHSQVQLQQSGAELARPGASVKMSCKASGYTFTRYTMHWVKQRPGQGLEWIGYINP
SRGYTNYNQKFKDKATLTTDKSSSTAYMQLSSLTSEDSAVYYCARYDDHYCLDYWGQGTTLTVSSAKTTAP
SVYPLAPVCGDTTGSSVTLGCLVKGYFPEPVTLTWNSGSLSSGVHTFPAVLQSDLYTLSSSVTVTSSTWPSQ
SITCNVAHPASSTKVDKKIEPRGPTIKPCPPCKCPAPNLLGGPSVFIFPPKIKDVLMISLSPIVTCVVVDVS
EDDPDVQISWFVNNVEVHTAQTQTHREDYNSTLRVVSALPIQHQDWMSGKEFKCKVNNKDLPAPIERTISKP
KGSVRAPQVYVLPPPEEEMTKKQVTLTCMVTDFMPEDIYVEMTNGKTELNYKNTEPVLDSDGSYFMYSKLR
VEKKNWVERNSYSCSVVHEGLHNHHTTKSFSRTPGK (SEQ ID NO: 622)

LC MDFQVQIFSFLLISASVIISRGQIVLTQSPAIMSASPGEKVTMTCSASSSVSYMNWYQQKSGTSPKRWIYDT
SKLASGVPAHFRGSGSGTSYSLTISGMEAEDAATYYCQQWSSNPFTFGSGTKLEINRADTAPTVSIFPPSSE
QLTSGGASVVCFLNNFYPKDINVKWKIDGSERQNGVLNSWTDQDSKDSTYSMSSTLTLTKDEYERHNSYTCE
ATHKTSTSPIVKSFNRNEC (SEQ ID NO: 623)

Group F

VH EVQLLESGGGLVQPGGSLRLSCAASGFTFSSFPMAWVRQAPGKGLEWVSTISTSGGRTYYRDSVKGRFTISR
DNSKNTLYLQMNSLRAEDTAVYYCAKFRQYSGGFDYWGQGTLVTVSS (SEQ ID NO: 624)

VL DFMLTQPHSVSESPGKTVIISCTLSSGNIENNYVHWYQQRPGRAPTTVIFDDDKRPDGVPDRFSGSIDRSSN
SASLTISGLQTEDEADYYCHSYVSSFNVFGGGTKLTVLGQPKAAPSVTLFPPSSEELQ
(SEQ ID NO: 625)

Group G

HC EVQLLESGGGLVQPGGSLRLSCAASGFTFSSFPMAWVRQAPGKGLEWVSTISTSGGRTYYRDSVKGRFTISR
DNSKNTLYLQMNSLRAEDTAVYYCAKFRQYSGGFDYWGQGTLVTVSSASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKK
VEPKSCDKTHTCPPCPAPELLGGPSVFLFPPKPKDTLMISRTPEVTCVVVDVSHEDPEVKFNWYVDGVEVHN
AKTKPREEQYASTYRVVSVLTVLHQDWLNGKEYKCKVSNKALPAPIEKTISKAKGQPREPQVYTLPPSRDEL
TKNQVSLTCLVKGFYPSDIAVEWESNGQPENNYKTTPPVLDSDGSFFLYSKLTVDKSRWQQGNVFSCSVMHE
ALHNHYTQKSLSLSPGK (SEQ ID NO: 626)

VL QAVVTQANSVSTSLGSTVKLSCTLSSGNIENNYVHWYQLYEGRSPTTMIYDDDKRPDGVPDRFSGSIDRSSN
SAFLTIHNVAIEDEAIYFCHSYVSSFNVFGGGTKLTVLR (SEQ ID NO: 627)

LC QAVVTQANSVSTSLGSTVKLSCTLSSGNIENNYVHWYQLYEGRSPTTMIYDDDKRPDGVPDRFSGSIDRSSN
SAFLTIHNVAIEDEAIYFCHSYVSSFNVFGGGTKLTVLRQPKAAPSVTLFPPSSEELQANKATLVCLISDFY
PGAVTVAWKADSSPVKAGVETTTPSKQSNNKYAASSYLSLTPEQWKSHRSYSCQVTHEGSTVEKTVAPTECS
(SEQ ID NO: 628)

Group H

VH EVKLVESGGGLVQPGGSLRLSCAASGFTFNTYAMNWVRQAPGKGLEWVARIRSKYNNYATYYADSVKDRFTI
SRDDSKSSLYLQMNNLKTEDTAMYYCVRHGNFGNSYVSWFAYWGQGTLVTVSS (SEQ ID NO: 629)

VH EVKLVESGGGLVKPGRSLRLSCAASGFTFNTYAMNWVRQAPGKGLEWVARIRSKYNNYATYYADSVKDRFTI
SRDDSKSILYLQMNNLKTEDTAMYYCVRHGNFGNSYVSWFAYWGQGTLVTVSS (SEQ ID NO: 630)

VH EVKLVESGGGLVKPGRSLRLSCAASGFTFNTYAMNWVRQAPGKGLEWVARIRSKYNNYATYYADSVKDRFTI
SRDDSKSILYLQMNSLKTEDTAMYYCVRHGNFGNSYVSWFAYWGQGTLVTVSS (SEQ ID NO: 631)

TABLE 17 -continued

Variable Heavy Chain Region (VH) and Variable Light Chain Region
(VL) Sequences for Activatable Antibodies that Bind CDR VH EVKLVESGGGLVKPGRSLRLSCAASGFTFNTYAMNWVRQAPGKGLEWVARIRSKYNNYATYYADSVKDRFTI
SRDDSKSILYLQMNSLKTEDTAMYYCVRHGNFGNSYVSWFAYWGQGTMVTVSS (SEQ ID NO: 632)

VL QAVVTOEPSFSVSPGGTVTLTCRSSTGAVTTSNYANWVQQTPGQAFRGLIGGTNKRAPGVPARFSGSLIGDK
AALTITGAQADDESIYFCALWYSNLWVFGGGTKLTVL (SEQ ID NO: 633)

VL QAVVTOEPSFSVSPGGTVTLTCRSSTGAVTTSNYANWVQQTPGQAFRGLIGGTNKRAPGVPARFSGSILGNK
AALTITGAQADDESIYFCALWYSNLWVFGGGTKLTVL (SEQ ID NO: 634)

VL QAVVTOEPSFSVSPGGTVTLTCRSSTGAVTTSNYANWVQQTPGQAFRGLIGGTNKRAPGVPARFSGSILGNK
AALTITGAQADDESDYYCALWYSNLWVFGGGTKLTVL (SEQ ID NO: 635)

Group I

VH EVQLVESGGGLVQPGRSLRLSCAASGFTFDDYTMHWVRQAPGKGLEWVSGISWNSGSIGYADSVKGRFTISR
DNAKKSLYLQMNSLRAEDTALYYCAKDNSGYGHYYYGMDVWGQGTTVTVAS (SEQ ID NO: 636)

VH EVQLVESGGGLVQPGGSLRLSCAATGFTFDDFTMHWVRQAPGKGLEWVSGISWNSGSIGYVDSVKGRFTISR
DNAKNSLYLQMNSLRAEDTALYYCAKDNSGYGYYYYGMDVWGQGTTVTVSS (SEQ ID NO: 637)

VH QVQLVESGGGVVQPGRSLRLSCAASGFTFRSYAMHWVRQAPGKGLEWVAMVYYDGNNQYYADSVRGRFTISR
DNSKNTLYLQMNSLRADDTAVYFCARGPGYNWLDPWGQGTLVTVSS (SEQ ID NO: 638)

VH QVQLVESGGGVVQPGRSLRLACVASGFTFRSYGMHWVRQAPGKGLQWVAMIYYDGKNKYYADSVRGRFTISR
DNSKNTLYLQMNNLRVEDTAMYFCARGPGYNWLDPWGQGTLVTVSS (SEQ ID NO: 639)

VH DVQLVQSGAEVKKPGASVKVSCKASGYTFTRYTMHWVRQAPGQGLEWIGYINPSRGYTNYADSVKGRFTITT
DKSTSTAYMELSSLRSEDTATYYCARYYDDHYCLDYWGQGTTVTVSS (SEQ ID NO: 640)

VL AEIVMTQSPATLSVSPGERATLSCRASQSVSSNLAWYQQKPGQAPRLLIYGASTRATGIPARFSGSGSGTEF
TLTISSLQSEDFAVYYCQHYINWPLTFGGGTKVEIK (SEQ ID NO: 641)

VL EIVMTQSPATLSVSPGERATLSCRASHSVSRNSAWYQQKPGQAPRLLIYGASTRATGIPARFSGSGSGTEFT
LTISSLQSEDFAIYYCQQYNNWPLTFGGGTKVEIK (SEQ ID NO: 642)

VL EIVMTQSPATLSVSPGERATLSCRASQSVSSNLAWYQQKPGQAPRLLIYGASTRATGIPARFSGSGSGTEFT
LTISSLQSEDFAVYYCQHYINWPLTFGGGTKVEIK (SEQ ID NO: 643)

VL EIVMTQSPATLSVSPGERATLSCRASQSVSRNLAWYQQKPGQAPRLLIYGASTRATGIPARFSGSGSGTDFT
LTISSLQSEDFAVYYCQQYNNWPLTFGGGTKVVIK (SEQ ID NO: 644)

VL EIVMTQSPATLSVSPGERATLSCRASQRISSNLAWYQQKPGQAPRLLIYGASTRATGSPARFSGSGSGTDFT
LTISSLQSEDVAVYYCQQHHNWPLTFGGGTKVEIK (SEQ ID NO: 645)

VL DIVLTQSPATLSLSPGERATLSCRASQSVSYMNWYQQKPGKAPKRWIYDTSKVASGVPARFSGSGSGTDYSL
TINSLEAEDAATYYCQQWSSNPLTFGGGTKVEIK (SEQ ID NO: 646)

Group J

VH QVQLVQSGAEVKKPGASVKVSCKASGYTFTRYTMHWVRQAPGQGLEWMGYINPSRGYTNYNQKFKDRVTMTT
DTSISTAYMELSRLRSDDTAVYYCARYYDDHYCLDYWGQGTLVTVSS (SEQ ID NO: 647)

VH QVQLVQSGAEVKKPGASVKVSCKASGYTFTRYTMHWVRQAPGQGLEWMGYINPSRGYTNYNQKFKDRVTMTT
DTSISTAYMELSRLRSDDTAVYYCARYYDDHYSLDYWGQGTLVTVSS (SEQ ID NO: 648)

VL EIVLTQSPATLSLSPGERATLSCSASSSVSYMNWYQQKPGQAPRLLIYDTSKLASGVPAHFRGSGSGTDYTL
TISSLEPEDFAVYYCQQWSSNPFTFGQGTKVEIK (SEQ ID NO: 649)

Group K

VH QVQLQQSGAELARPGASVKMSCKASGYTFTRYTMHWVKQRPGQGLEWIGYINPSRGYTNYNQKFKDKATLTT
DKSSSTAYMQLSSLTSEDSAVYYCARYYDDHYCLDYWGQGTTLTVSS (SEQ ID NO: 596)

VL QIVLTQSPAIMSASPGEKVTMTCSASSSVSYMNWYQQKSGTSPKRWIYDTSKLASGVPAHFRGSGSGTSYSL
TISGMEAEDAATYYCQQWSSNPFTFGSGTKLEIN (SEQ ID NO: 650)

Group L

VH QVQLVQSGSELKKPGASVKMSCKASGYTFTRYTMHWVRQAPGKGLEWIGYINPSRGYTNYNQKFKDRATLTT
DKSTSTAYMQLSSLRSEDTAVYYCARYYDDHYSLDYWGQGTLVTVSS (SEQ ID NO: 651)

VL QIVLTQSPATLSLSPGERATMSCSASSSVSYMNWYQQKPGKAPKRWIYDTSKLASGVPSRFRGSGSGTDYTL
TISSLQPEDFATYYCQQWSSNPFTFGGGTKVEIK(SEQ ID NO: 652)

TABLE 17 -continued

Variable Heavy Chain Region (VH) and Variable Light Chain Region
(VL) Sequences for Activatable Antibodies that Bind CDR Group M VH EVQLVESGGGLVQPGGSLRLSCAASGFTFSTYAMNWVRQAPGKGLEWVGRIRSKYNNYATYYADSVKDRFTI
SRDDSKNSLYLQMNSLKTEDTAVYYCARHGNFGNSYVSWFAYWGQGTLVTVSS (SEQ ID NO: 653)

VH EVQLVESGGGLVQPGGSLRLSCAASGFTFNTYAMNWVRQAPGKGLEWVGRIRSKYNNYATYYADSVKDRFTI
SRDDSKNSLYLQMNSLKTEDTAVYYCARHGNFGNSYVSWFAYWGQGTLVTVSS (SEQ ID NO: 654)

VH EVQLVESGGGLVQPGGSLRLSCAASGFTFSTYAMNWVRQAPGKGLEWVARIRSKYNNYATYYADSVKDRFTI
SRDDSKNSLYLQMNSLKTEDTAVYYCARHGNFGNSYVSWFAYWGQGTLVTVSS (SEQ ID NO: 655)

VH EVQLVESGGGLVQPGGSLRLSCAASGFTFSTYAMNWVRQAPGKGLEWVGRIRSKYNNYATYYADSVKDRFTI
SRDDSKNSLYLQMNSLKTEDTAVYYCVRHGNFGNSYVSWFAYWGQGTLVTVSS (SEQ ID NO: 656)

VH EVQLVESGGGLVQPGGSLRLSCAASGFTFNTYAMNWVRQAPGKGLEWVARIRSKYNNYATYYADSVKDRFTI
SRDDSKNSLYLQMNSLKTEDTAVYYCARHGNFGNSYVSWFAYWGQGTLVTVSS (SEQ ID NO: 657)

VH EVQLVESGGGLVQPGGSLRLSCAASGFTFNTYAMNWVRQAPGKGLEWVGRIRSKYNNYATYYADSVKDRFTI
SRDDSKNSLYLQMNSLKTEDTAVYYCVRHGNFGNSYVSWFAYWGQGTLVTVSS (SEQ ID NO: 658)

VH EVQLVESGGGLVQPGGSLRLSCAASGFTFNTYAMNWVRQAPGKGLEWVGRIRNKYNNYATEYADSVKDRFTI
SRDDSKNSLYLQMNSLKTEDTAVYYCVRHGNFGNSYVSWFAYWGQGTLVTVSS (SEQ ID NO: 659)

VH EVQLVESGGGLVQPGGSLRLSCAASGFTFSTYAMNWVRQAPGKGLEWVARIRSKYNNYATYYADSVKDRFTI
SRDDSKNSLYLQMNSLKTEDTAVYYCVRHGNFGNSYVSWFAYWGQGTLVTVSS (SEQ ID NO: 660)

VH EVQLVESGGGLVQPGGSLRLSCAASGFTFNTYAMNWVRQAPGKGLEWVARIRSKYNNYATYYADSVKDRFTI
SRDDSKNSLYLQMNSLKTEDTAVYYCVRHGNFGNSYVSWFAYWGQGTLVTVSS (SEQ ID NO: 661)

VH EVQLVESGGGLVQPGGSLRLSCAASGFTFNTYAMNWVRQAPGKGLEWVARIRNKYNNYATEYADSVKDRFTI
SRDDSKNSLYLQMNSLKTEDTAVYYCVRHGNFGNSYVSWFAYWGQGTLVTVSS (SEQ ID NO: 662)

VH EVQLVESGGGLVQPGGSLRLSCAASGFTFNTYAMNWVRQAPGKGLEWVARTRSKANSYTTYYAASVKGRFTI
SRDDSKNSLYLQMNSLKTEDTAVYYCARHGNFGNSYVSWFAYWGQGTLVTVSS (SEQ ID NO: 663)

VH EVQLVESGGGLVQPGGSLRLSCAASGFTFNTYAMNWVRQAPGKGLEWVGRTRSKANSYTTYYAASVKGRFTI
SRDDSKNSLYLQMNSLKTEDTAVYYCARHGNFGNSYVSWFAYWGQGTLVTVSS (SEQ ID NO: 664)

VH EVQLVESGGGLVQPGGSLRLSCAASGFTFNTYAMNWVRQAPGKGLEWVGRIRSKYNNYATEYAASVKDRFTI
SRDDSKNSLYLQMNSLKTEDTAVYYCVRHGNFGNSYVSWFAYWGQGTLVTVSS (SEQ ID NO: 665)

VH EVQLVESGGGLVQPGGSLRLSCAASGFTFNTYAMNWVRQAPGKGLEWVARIRNKYNNYATEYAASVKDRFTI
SRDDSKNSLYLQMNSLKTEDTAVYYCVRHGNFGNSYVSWFAYWGQGTLVTVSS (SEQ ID NO: 666)

VH EVQLVESGGGLVQPGGSLRLSCAASGFTFNTYAMNWVRQAPGKGLEWVGRTRSKANSYTTYYAASVKGRFTI
SRDDSKNSLYLQMNSLKTEDTAVYYCARHGNFGNSYVSWFAYWGQGTLVTVSS (SEQ ID NO: 667)

VH EVQLVESGGGLVQPGGSLRLSCAASGFTFNTYAMNWVRQAPGKGLEWVARTRSKANSYTTYYAASVKGRFTI
SRDDSKNSLYLQMNSLKTEDTAVYYCARHGNFGNSYVSWFAYWGQGTLVTVSS (SEQ ID NO: 668)

VH QVQLVQSGAEVKKPGASVKVSCKASGYTFTRSTMHWVRQAPGQGLEWIGYINPSSAYTNYNQKFKDRVTITA
DKSTSTAYMELSSLRSEDTAVYYCASPQVHYDYNGFPYWGQGTLVTVSS (SEQ ID NO: 669)

VL QAVVTQEPSLTVSPGGTVTLTCRSSTGAVTTSNYANWFQQKPGQAPRTLIGGTNKRAPWTPARFSGSLLGGK
AALTITGAQAEDEADYYCALWYSNLWVFGGGTKLTVLG (SEQ ID NO: 670)

VL QAVVTQEPSLTVSPGGTVTLTCRSSTGAVTTSNYANWVQQKPGQAPRTLIGGTNKRAPWTPARFSGSLLGGK
AALTITGAQAEDEADYYCALWYSNLWVFGGGTKLTVLG (SEQ ID NO: 671)

VL QAVVTQEPSLTVSPGGTVTLTCRSSTGAVTTSNYANWFQEKPGQAPRTLIGGTNKRAPWTPARFSGSLLGGK
AALTITGAQAEDEADYYCALWYSNLWVFGGGTKLTVLG (SEQ ID NO: 672)

VL QAVVTQEPSLTVSPGGTVTLTCRSSTGAVTTSNYANWFQQKPGQAPRGLIGGTNKRAPWTPARFSGSLLGGK
AALTITGAQAEDEADYYCALWYSNLWVFGGGTKLTVLG (SEQ ID NO: 673)

VL QAVVTQEPSLTVSPGGTVTLTCRSSTGAVTTSNYANWVQEKPGQAPRTLIGGTNKRAPWTPARFSGSLLGGK
AALTITGAQAEDEADYYCALWYSNLWVFGGGTKLTVLG (SEQ ID NO: 674)

VL QAVVTQEPSLTVSPGGTVTLTCRSSTGAVTTSNYANWVQQKPGQAPRGLIGGTNKRAPWTPARFSGSLLGGK
AALTITGAQAEDEADYYCALWYSNLWVFGGGTKLTVLG (SEQ ID NO: 675)

VL QAVVTQEPSLTVSPGGTVTLTCRSSTGAVTTSNYANWFQEKPGQAPRGLIGGTNKRAPWTPARFSGSLLGGK
AALTITGAQAEDEADYYCALWYSNLWVFGGGTKLTVLG (SEQ ID NO: 676)

VL QAVVTQEPSLTVSPGGTVTLTCRSSTGAVTTSNYANWVQEKPGQAPRGLIGGTNKRAPWTPARFSGSLLGGK
AALTITGAQAEDEADYYCALWYSNLWVFGGGTKLTVLG (SEQ ID NO: 677)

TABLE 17 -continued

Variable Heavy Chain Region (VH) and Variable Light Chain Region
(VL) Sequences for Activatable Antibodies that Bind CDR VL QAVVTQEPSLTVSPGGTVTLTCRSSTGAVTTSNYANWVQEKPGQAFRGLIGGTNKRAPWTPARFSGSLLGGK
AALTITGAQAEDEADYYCALWYSNLWVFGGGTKLTVLG (SEQ ID NO: 678)

VL DIQMTQSPSSLSASVGDRVTITCSASSSVSYMNWYQQKPGKAPKRLIYDSSKLASGVPSRFSGSGSGTEFTL
TISSLQPEDFATYYCQQWSRNPPTFGGGTKVEIK (SEQ ID NO: 679)

VL DVVMTQSPAIMSAFPGEKVTITCSASSSVSYMNWYQQKPGKAPKRWIYDSSKLASGVPSRFSGSGSGTEFTL
TISSLQPEDFATYYCQQWSRNPPTFGGGTKVEIK (SEQ ID NO: 680)

Group N

VH QVQLVQSGAEVKKPGASVKVSCKASGYTFTRSTMHWVKQAPGQGLEWIGYINPSSAYTNYNQKFKDKATLTA
DKSSSTAYMQLSSLRSEDTAVYYCARPQVHYDYNGFPYWGQGTLVTVSS (SEQ ID NO: 681)

VH QVQLVQSGGGVVQPGRSLRLSCKASGYTFTRSTMHWVRQAPGKGLEWIGYINPSSAYTNYNQKFKDKATLTA
DKSKNTAYMELSSLRSEDTAVYYCARPQVHYDYNGFPYWGQGTLVTVSS (SEQ ID NO: 682)

VH QVQLVQSGGGVVQPGRSLRLSCKASGYTFTRSTMHWVRQAPGKGLEWIGYINPSSAYTNYNQKFKDRFTISA
DKSKSTAFLQMDSLRPEDTGVYFCARPQVHYDYNGFPYWGQGTPVTVSS (SEQ ID NO: 683)

VH QVQLVESGGGVVQPGRSLRLSCKASGYTFTRSTMHWVRQAPGQGLEWIGYINPSSAYTNYNQKFKDRFTISA
DKSKSTAFLQMDSLRPEDTGVYFCARPQVHYDYNGFPYWGQGTPVTVSS (SEQ ID NO: 684)

VH QVQLVQSGAEVKKPGASVKVSCKASGYTFTRSTMHWVRQAPGQRLEWMGYINPSSAYTNYNQKFKDRVTITR
DTSASTAYMELSSLRSEDTAVYYCARPQVHYDYNGFPYWGQGTLVTVSS (SEQ ID NO: 685)

VH EVQLVESGGGLVKPGGSLRLSCAASGFTFSRSTMHWVRQAPGKGLEWVSYINPSSAYTNYNQKFKDRFTISR
DNAKNSLYLQMNSLRAEDTAVYYCARPQVHYDYNGFPYWGQGTLVTVSS(SEQ ID NO: 686)

VL AQDIQMTQSPSSLSASVGDRVTMTCSASSSVSYMNWYQQKPGKAPKLLIYDSSKLASGVPARFSGSGSGTDY
TLTISSLQPEDFATYYCQQWSRNPPTFGGGTKVEIK (SEQ ID NO: 687)

VL EIVLTQSPATLSLSPGERATLSCSASSSVSYMNWYQQKPGQAPRLLIYDSSKLASGIPARFSGSGSGTDFTL
TISSLEPEDFAVYYCQQWSRNPPTFGGGTKVEIK (SEQ ID NO: 688)

VL AQDIQMTQSPSSLSASVGDRVTMTCSASSSVSYMNWYQQKPGKAPKRWIYDSSKLASGVPARFSGSGSGTDY
TLTISSLQPEDFATYYCQQWSRNPPTFGGGTKLQIT (SEQ ID NO: 689)

VL AQDIQMTQSPSSLSASVGDRVTITCSASSSVSYMNWYQQTPGKAPKRWIYDSSKLASGVPSRFSGSGSGTDF
TLTISSLQPEDIATYYCQQWSRNPPTFGQGTKLQIT (SEQ ID NO: 690)

Group O

VH QVQLVESGGGVVQPGRSLRLSCAASGFKFSGYGMHWVRQAPGKGLEWVAVIWYDGSKKYYVDSVKGRFTISR
DNSKNTLYLQMNSLRAEDTAVYYCARQMGYWHFDLWGRGTLVTVSS (SEQ ID NO: 691)

VH QVQLVQSGGGVVQSGRSLRLSCAASGFKFSGYGMHWVRQAPGKGLEWVAVIWYDGSKKYYVDSVKGRFTISR
DNSKNTLYLQMNSLRGEDTAVYYCARQMGYWHFDLWGRGTLVTVSS (SEQ ID NO: 692)

VH QVQLVESGGGVVQPGRSLRLSCAASGFTFRSYGMHWVRQAPGKGLEWVAIIWYDGSKKNYADSVKGRFTISR
DNSKNTLYLQMNSLRAEDTAVYYCARGTYNWFDPWGQGTLVTVSS (SEQ ID NO: 693)

VH QVQLVQSGGGVVQPGRSLRLSCVASGFTFSSYGMHWVRQAPGKGLEWVAAIWYNGRKQDYADSVKGRFTISR
DNSKNTLYLQMNSLRAEDTAVYYCTRGTYNWFDPWGQGTLVTVSS (SEQ ID NO: 694)

VL EIVLTQSPATLSLSPGERATLSCRASQSVSSYLAWYQQKPGQAPRLLIYDASNRATGIPARFSGSGSGTDFT
LTISSLEPEDFAVYYCQQRSNWPPLTFGGGTKVEIK (SEQ ID NO: 695)

VL EIVLTQSPRTLSLSPGERATLSCRASQSVSSSYLAWYQQKPGQAPRLLIYGASSRATGIPDRFSGSGSGTDF
TLTISRLDPEDFAVYYCQQYGSSPITFGQGTRLEIK (SEQ ID NO: 696)

VL DILMTQSPSSLSASVGDRVTITCRASQGISSALAWYQQKPGKAPKLLIYYASSLQSGVPSRFSGSGSGTDYT
LTISSLQPEDFATYYCQQYYSTLTFGGGTKVEIK (SEQ ID NO: 697)

VL DIVMTQSPSSLSASVGDRVTITCRASQGISSALAWYQQKPGKAPKLLIYDASSLGSGVPSRFSGSGSGTDFT
LTISSLQPEDFATYYCQQYYSTLTFGGGTKVEIK (SEQ ID NO: 698)

VL DIQMTQSPFSLSASVGDRVTITCWASQGISSYLAWYQQKPAKAPKLFIYYASSLQSGVPSRFSGSGSGTDYT
LTISSLQPEDFATYYCQQYYSTLTFGGGTKVEIK (SEQ ID NO: 699)

VL DIEMTQSPFSLSASVGDRVTITCWASQGISSYLAWYQQKPAKAPKLFIYYASSLQSGVPSRFSGSGSGTDYT
LTISSLQPEDFATYYCQQYYSTLTFGGGTKVEIK (SEQ ID NO: 700)

VL EIVLTQSPATLSLSPGERATLSCRASQSVSSYLAWYQQKPGQAPRLLIYDASNRATGIPARFSGSGSGTDFT
LTISSLEPEDFAVYYCQQRSNWPWTFGQGTKVEIK (SEQ ID NO: 701)

TABLE 17 -continued

Variable Heavy Chain Region (VH) and Variable Light Chain Region (VL) Sequences for Activatable Antibodies that Bind CDR VL AIQLTQSPSSLSASVGDRVTITCRASQGISSALAWYQQKPGKAPKLLIYDASSLESGVPSRFSGSGSGTDFT
LTISSLQPEDFATYYCQQFNSYPITFGQGTRLEIK (SEQ ID NO: 702)

Group P

VH QVQLVQSGAEVKKPGASVKVSCKASGYTFISYTMHWVRQAPGQGLEWMGYINPRSGYTHYNQKLKDKATLTA
DKSASTAYMELSSLRSEDTAVYYCARSAYYDYDGFAYWGQGTLVTVSS (SEQ ID NO: 703)

VL DIQMTQSPSSLSASVGDRVTITCSASSSVSYMNWYQQKPGKAPKRLIYDTSKLASGVPSRFSGSGSGTDFTL
TISSLQPEDFATYYCQQWSSNPPTFGGGTKVEIK (SEQ ID NO: 704)

Group Q

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 705)

VH EVQLVESGGGDVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 706)

VH EVQLVESGGGKVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 707)

VH EVQLVESGGGNVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 708)

VH EVQLVESGGGSVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 709)

VH EVQLVESGGGLVQPGGSLKLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 710)

VH EVQLVESGGGLVQPGGSLRLSCAASGFTFSTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 711)

VH EVQLVESGGGLVQPGGSLRLSCAASGFTFNTYAMHWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 712)

VH EVQLVESGGGLVQPGGSLRLSCAASGFTFNTYAMSWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 713)

VH EVQLVESGGGLVQPGGSLRLSCAASGFTFNTYAMNWVRQASGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 714)

VH EVQLVESGGGLVQPGGSLRLSCAASGFTFNTYAMNWVRQAPGKGLEWVGRIRSKANNYATYYADSVKGRFTI
SRDDSKNTLYLQMNSLRAEDTAVYYCVRHGNFGNSYVSWFAYWGQGTLVTVSS (SEQ ID NO: 715)

VH EVQLVESGGGLVQPGGSLRLSCAASGFTFNTYAMNWVRQAPGKGLEWVGRIRSKANSYATYYADSVKGRFTI
SRDDSKNTLYLQMNSLRAEDTAVYYCVRHGNFGNSYVSWFAYWGQGTLVTVSS (SEQ ID NO: 716)

VH EVQLVESGGGLVQPGGSLRLSCAASGFTFNTYAMNWVRQAPGKGLEWVGRIRSKYNNYATAYADSVKGRFTI
SRDDSKNTLYLQMNSLRAEDTAVYYCVRHGNFGNSYVSWFAYWGQGTLVTVSS (SEQ ID NO: 717)

VH EVQLVESGGGLVQPGGSLRLSCAASGFTFNTYAMNWVRQAPGKGLEWVGRIRSKYNNYATYYAASVKGRFTI
SRDDSKNTLYLQMNSLRAEDTAVYYCVRHGNFGNSYVSWFAYWGQGTLVTVSS (SEQ ID NO: 718)

VH EVQLVESGGGLVQPGGSLRLSCAASGFTFNTYAMNWVRQAPGKGLEWVGRIRSKYNNYATYYADSVKGRFTI
SRDNSKNTLYLQMNSLRAEDTAVYYCVRHGNFGNSYVSWFAYWGQGTLVTVSS (SEQ ID NO: 719)

VH EVQLVESGGGLVQPGGSLRLSCAASGFTFNTYAMNWVRQAPGKGLEWVGRIRSKYNNYATYYADSVKGRFTI
SRDTSKNTLYLQMNSLRAEDTAVYYCVRHGNFGNSYVSWFAYWGQGTLVTV (SEQ ID NO: 720)

VH EVQLVESGGGLVQPGGSLRLSCAASGFTFNTYAMNWVRQAPGKGLEWVGRIRSKYNNYATYYADSVKGRFTI
SRDDSKNTAYLQMNSLRAEDTAVYYCVRHGNFGNSYVSWFAYWGQGTLVTVSS (SEQ ID NO: 721)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRDEDTAVYYCVRHGNFGNSYVSWFAYWGQGTLVTVSS (SEQ ID NO: 722)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRKEDTAVYYCVRHGNFGNSYVSWFAYWGQGTLVTVSS (SEQ ID NO: 723)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRSEDTAVYYCVRHGNFGNSYVSWFAYWGQGTLVTVSS (SEQ ID NO: 724)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCARHGNFGNSYVSWFAYWGQGTLVTVSS (SEQ ID NO: 725)

TABLE 17 -continued

Variable Heavy Chain Region (VH) and Variable Light Chain Region (VL) Sequences for Activatable Antibodies that Bind CDR VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCTRHGNFGNSYVSWFAYWGQGTLVTVSS (SEQ ID NO: 726)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGDSYVSWFAYWGQGTLVTVSS (SEQ ID NO: 727)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGQSYVSWFAYWGQGTLVTVSS (SEQ ID NO: 728)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNTYVSWFAYWGQGTLVTVSS (SEQ ID NO: 729)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFDYWGQGTLVTVSS (SEQ ID NO: 730)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTTVTVSS (SEQ ID NO: 731)

VH EVQLVESGGGLVQPGGSLRLSCAASGFTFNTYAMNWVRQAPGKSLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 732)

VH EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTATYYCVRHGNFGNSYVSWFAYWGQGTLVTVSS (SEQ ID NO: 733)

VH EVQLVESGGGLVQPGGSLRLSCAASGFTFSTYAMNWVRQAPGKGLEWVGRIRSKYNNYATYYADSVKGRFTI
SRDDSKNTLYLQMNSLRAEDTAVYYCVRHGNFGDSYVSWFAYWGQGTLVTVSS (SEQ ID NO: 734)

VH EVQLVESGGGLVQPGGSLRLSCAASGFTFSTYAMSWVRQAPGKGLEWVGRIRSKYNNYATYYADSVKGRFTI
SRDDSKNTLYLQMNSLRAEDTAVYYCVRHGNFGDSYVSWFAYWGQGTLVTVSS (SEQ ID NO: 735)

VH EVQLVESGGGLVQPGGSLRLSCAASGFTFSTYAMNWVRQAPGKGLEWVGRIRSKANNYATYYADSVKGRFTI
SRDDSKNTLYLQMNSLRAEDTAVYYCVRHGNFGDSYVSWFAYWGQGTLVTVSS (SEQ ID NO: 736)

VH EVQLVESGGGLVQPGGSLRLSCAASGFTFSTYAMNWVRQAPGKGLEWVGRIRSKYNNYATYYADSVKGRFTI
SRDDSKNTLYLQMNSLRAEDTAVYYCVRHGNFGDSYVSWFDYWGQGTLVTVSS (SEQ ID NO: 737)

VH EVQLVESGGGLVQPGGSLRLSCAASGFTFSTYAMSWVRQAPGKGLEWVGRIRSKANNYATYYADSVKGRFTI
SRDDSKNTLYLQMNSLRAEDTAVYYCVRHGNFGDSYVSWFDYWGQGTLVTVSS (SEQ ID NO: 738)

VH EVQLVESGGEVKKPGESLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 739)

VH EVQLVESGGGLVQPGGSLRLSCAASGFTFNTYAMNWVRQAPGKGLEWVGRIRSNGGSTYYADSVKGRFTISR
DDSKNTLYLQMNSLRAEDTAVYYCVRHGNFGNSYVSWFAYWGQGTLVTVSS (SEQ ID NO: 740)

VH EVQLVESGGGLVQPGGSLRLSCAASGFTFNTYAMNWVRKAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 741)

VH EVQLVESGGGLVQPGGSLRLSCAASGFTFSTYAMNWVRKAPGKGLEWVGRIRSKYNNYATYYADSVKGRFTI
SRDDSKNTLYLQMNSLRAEDTAVYYCVRHGNFGNSYVSWFAYWGQGTLVTVSS (SEQ ID NO: 742)

VH EVQLVESGGGLVQPGGSLRLSCAASGFTFSTYAMNWVRKAPGKGLEWVGRIRSKYNNYATYYADSVKGRFTI
SRDDSKNTLYLQMNSLRAEDTAVYYCVRHGNFGDSYVSWFAYWGQGTLVTVSS (SEQ ID NO: 743)

VL QAVVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL (SEQ ID NO: 744)

VL QAVVTQPPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL (SEQ ID NO: 745)

VL QAVVTQEPSLSVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL (SEQ ID NO: 746)

VL QAVVTQEPSLTVSPGATVTLTCGSSTGAVTTSNYANWVQQKPGQAPRGLIGGTNKRAPGVPARFSGSLLGGK
AALTLSGAQPEDEAEYYCALWYSNLWVFGGGTKLTVL (SEQ ID NO: 747)

VL QAVVTQEPSLTVSPGQTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL (SEQ ID NO: 748)

VL QAVVTQEPSLTVSPGGTVTLTCGSSTGAVTSSNYANWVQQKPGQAPRGLIGGTNKRAPGVPARFSGSLLGGK
AALTLSGAQPEDEAEYYCALWYSNLWVFGGGTKLTVL (SEQ ID NO: 749)

VL QAVVTQEPSLTVSPGGTVTLTCGSSTGAVTSGHYANWVQQKPGQAPRGLIGGTNKRAPGVPARFSGSLLGGK
AALTLSGAQPEDEAEYYCALWYSNLWVFGGGTKLTVL (SEQ ID NO: 750)

VL QAVVTQEPSLTVSPGGTVTLTCGSSTGAVTTSNYANWVQQKPGQAPRGLIYDTNKRAPGVPARFSGSLLGGK
AALTLSGAQPEDEAEYYCALWYSNLWVFGGGTKLTVL (SEQ ID NO: 751)

TABLE 17 -continued

Variable Heavy Chain Region (VH) and Variable Light Chain Region (VL) Sequences for Activatable Antibodies that Bind CDR VL QAVVTQEPSLTVSPGGTVTLTCGSSTGAVTTSNYANWVQQKPGQAPRGLIGGTNNRAPGVPARFSGSLLGGK
AALTLSGAQPEDEAEYYCALWYSNLWVFGGGTKLTVL (SEQ ID NO: 752)

VL QAVVTQEPSLTVSPGGTVTLTCGSSTGAVTTSNYANWVQQKPGQAPRGLIGGTNKRASGVPARFSGSLLGGK
AALTLSGAQPEDEAEYYCALWYSNLWVFGGGTKLTVL (SEQ ID NO: 753)

VL QAVVTQEPSLTVSPGGTVTLTCGSSTGAVTTSNYANWVQQKPGQAPRGLIGGTSNKHSWTPARFSGSLLGGK
AALTLSGAQPEDEAEYYCALWYSNLWVFGGGTKLTVL (SEQ ID NO: 754)

VL QAVVTQEPSLTVSPGGTVTLTCGSSTGAVTTSNYANWVQQKPGQAPRGLIGGTNKRAPGVPDRFSGSLLGGK
AALTLSGAQPEDEAEYYCALWYSNLWVFGGGTKLTVL (SEQ ID NO: 755)

VL QAVVTQEPSLTVSPGGTVTLTCGSSTGAVTTSNYANWVQQKPGQAPRGLIGGTNKRAPGVPARFSGSKSGGK
AALTLSGAQPEDEAEYYCALWYSNLWVFGGGTKLTVL (SEQ ID NO: 756)

VL QAVVTQEPSLTVSPGGTVTLTCGSSTGAVTTSNYANWVQQKPGQAPRGLIGGTNKRAPGVPARFSGSSSGGK
AALTLSGAQPEDEAEYYCALWYSNLWVFGGGTKLTVL (SEQ ID NO: 757)

VL QAVVTQEPSLTVSPGGTVTLTCGSSTGAVTTSNYANWVQQKPGQAPRGLIGGTNKRAPGVPARFSGSLLGGK
AALTISGAQPEDEAEYYCALWYSNLWVFGGGTKLTVL (SEQ ID NO: 758)

VL QAVVTQEPSLTVSPGGTVTLTCGSSTGAVTTSNYANWVQQKPGQAPRGLIGGTNKRAPGVPARFSGSLLGGK
AALTLSGAQAEDEAEYYCALWYSNLWVFGGGTKLTVL (SEQ ID NO: 759)

VL QAVVTQEPSLTVSPGGTVTLTCGSSTGAVTTSNYANWVQQKPGQAPRGLIGGTNKRAPGVPARFSGSLLGGK
AALTLSGAQSEDEAEYYCALWYSNLWVFGGGTKLTVL (SEQ ID NO: 760)

VL QAVVTQEPSLTVSPGGTVTLTCGSSTGAVTTSNYANWVQQKPGQAPRGLIGGTNKRAPGVPARFSGSLLGGK
AALTLSGAQPEDEADYYCALWYSNLWVFGGGTKLTVL (SEQ ID NO: 761)

VL QAVVTQEPSLTVSPGGTVTLTCGSSTGAVTTSNYANWVQQKPGQAPRGLIGGTNKRAPGVPARFSGSLLGGK
AALTLSGAQPEDEAEYYCLLWYSNLWVFGGGTKLTVL (SEQ ID NO: 762)

VL QAVVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNHWVFGGGTKLTVL (SEQ ID NO: 763)

VL QAVVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLEIKGS (SEQ ID NO: 764)

VL EIVMTQSPATLSLSPGERATLSCRSSTGAVTTSNYANWVQQKPGQAPRGLIGGTNKRAPGVPARFSGSGSGT
DFTLTISSLQPEDFAVYYCALWYSNLWVFGGGTKVEIKGS (SEQ ID NO: 765)

VL DIVMTQSPDSLAVSLGERATINCKSSTGAVTTSNYANWVQQKPGQPPKGLIGGTNKRAPGVPDRFSGSGSGT
DFTLTISSLQAEDVAVYYCALWYSNLWVFGGGTKVEIKGS (SEQ ID NO: 766)

VL QAVVTQEPSLTVSPGGTVTLTCGSSTGAVTTSNYANWVQQKPGQAPRGLIGGTNKRAPGVPARFSGSLLGGK
AALTDSGAQPEDEADYYCALWYSNHWVFGGGTKLTVL (SEQ ID NO: 767)

VL QAVVTQEPSLTVSPGGTVTLTCGSSTGAVTTSNYANWVQEKPGQAPRGLIGGTNKRAPGVPARFSGSLLGGK
AALTLSGAQPEDEAEYYCALWYSNLWVFGGGTKLTVL (SEQ ID NO: 768)

VL QAVVTQEPSLTVSPGGTVTLTCGSSTGAVTTSNYANWVQQKPGKAPRGLIGGTNKRAPGVPARFSGSLLGGK
AALTLSGAQPEDEAEYYCALWYSNLWVFGGGTKLT (SEQ ID NO: 769)

VL QAVVTQEPSLTVSPGGTVTLTCGSSTGAVTTSNYANWVQQKPGTAPRGLIGGTNKRAPGVPARFSGSLLGGK
AALTLSGAQPEDEAEYYCALWYSNLWVFGGGTKLTVL (SEQ ID NO: 770)

VL QAVVTQEPSLTVSPGGTVTLTCGSSTGAVTTSNYANWVQQKPGSPPRGLIGGTNKRAPGVPARFSGSLLGGK
AALTLSGAQPEDEAEYYCALWYSNLWVFGGGTKLTVL (SEQ ID NO: 771)

VL QAVVTQEPSLTVSPGGTVTLTCGSSTGAVTTSNYANWVQQKPGQPPRGLIGGTNKRAPGVPARFSGSLLGGK
AALTLSGAQPEDEAEYYCALWYSNLWVFGGGTKLTVL (SEQ ID NO: 772)

VL QAVVTQEPSLTVSPGGTVTLTCGSSTGAVTTSNYANWVQQKPGQGPRGLIGGTNKRAPGVPARFSGSLLGGK
AALTLSGAQPEDEAEYYCALWYSNLWVFGGGTKLTVL (SEQ ID NO: 773)

VL QAVVTQEPSLTVSPGGTVTLTCGSSTGAVTTSNYANWVQQKPGQSPRGLIGGTNKRAPGVPARFSGSLLGGK
AALTLSGAQPEDEAEYYCALWYSNLWVFGGGTKLTVL (SEQ ID NO: 774)

VL QAVVTQEPSLTVSPGGTVTLTCGSSTGAVTTSNYANWVQQKPGQDPRGLIGGTNKRAPGVPARFSGSLLGGK
AALTLSGAQPEDEAEYYCALWYSNLWVFGGGTKLTVL (SEQ ID NO: 775)

VL QAVVTQEPSLTVSPGGTVTLTCGSSTGAVTTSNYANWVQQKPGQAPRGLIGGTNKRAPGVPARFSGSLLGGK
AALTISGAQPEDEADYYCALWYSNHWVFGGGTKLTVL (SEQ ID NO: 776)

TABLE 17 -continued

Variable Heavy Chain Region (VH) and Variable Light Chain Region
(VL) Sequences for Activatable Antibodies that Bind CDR VL  QAVVTQEPSLTVSPGGTVTLTCGSSTGAVTTSNYANWVQQKPGQAPRGLIGGTNKRAPGVPARFSGSLLGGK
    AALTISGAQPEDEAEYYCALWYSNHWVFGGGTKLTVL (SEQ ID NO: 777)

VL  QAVVTQEPSLTVSPGGTVTLTCGSSTGAVTTSNYANWVQQKPGKAPRGLIGGTNKRAPGVPARFSGSLLGGK
    AALTISGAQPEDEAEYYCALWYSNHWVFGGGTKLTVL (SEQ ID NO: 778)

VL  QAVVTQEPSLTVSPGGTVTLTCGSSTGAVTTSNYANWVQQKPGQSPRGLIGGTNKRAPGVPARFSGSLLGGK
    AALTISGAQPEDEAEYYCALWYSNHWVFGGGTKLTVL (SEQ ID NO: 779)

VL  QAVVTQEPSLTVSPGGTVTLTCGSSTGAVTTSNYANWVQQKPGKSPRGLIGGTNKRAPGVPARFSGSLLGGK
    AALTISGAQPEDEAEYYCALWYSNHWVFGGGTKLTVL (SEQ ID NO: 780)

VL  QAVVTQEPSLTVSPGGTVTLTCGSSTGAVTTSNYANWVQQKPGKAPRGLIGGTNKRAPGVPARFSGSLLGGK
    AALTISGAQPEDEADYYCALWYSNHWVFGGGTKLTVL (SEQ ID NO: 781)

VL  QAVVTQEPSLTVSPGGTVTLTCGSSTGAVTTSNYANWVQQKPGQSPRGLIGGTNKRAPGVPARFSGSLLGGK
    AALTISGAQPEDEADYYCALWYSNHWVFGGGTKLTVL (SEQ ID NO: 782)

VL  QAVVTQEPSLTVSPGGTVTLTCGSSTGAVTTSNYANWVQQKPGKSPRGLIGGTNKRAPGVPARFSGSLLGGK
    AALTISGAQPEDEADYYCALWYSNHWVFGGGTKLTVL (SEQ ID NO: 783)

In some embodiments, the activatable anti-CD3ε antibody comprises or is derived from a commercially available antibody, such as, for example, an anti-CD3 antibody from Boehringer Mannheim Corp. (Indianapolis, Ind.; Cat. No. 1273 485).

In some embodiments, the activatable anti-CD3ε antibody comprises or is derived from an antibody that is manufactured, secreted or otherwise produced by a hybridoma, such as, for example, the hybridoma(s) disclosed in U.S. Pat. Nos. 4,361,549 and/or 4,658,019, and deposited at the American Type Culture Collection under Accession Number ATCC CRL 8001 OKT-3.

In some embodiments, the activatable anti-CD3ε antibody comprises or is derived from an antibody that is manufactured, secreted or otherwise produced by a hybridoma, such as, for example, the hybridoma(s) disclosed in PCT Publication No. WO 1995/16037, and deposited at the Leibniz-Institut DSMZ—Deutsche Sammlung von Mikroorganismen and Zellkulturen GmbH under Accession Number DSM ACC2152.

In some embodiments, the activatable anti-CD3ε antibody comprises or is derived from an antibody that is manufactured, secreted or otherwise produced by a hybridoma, such as, for example, the hybridoma(s) disclosed in PCT Publication No. WO 1991/01752, and deposited at the American Type Culture Collection under Accession Number HB 10166.

In some embodiments, the activatable anti-CD3ε antibody includes a CDR sequence shown in Table 18, a combination of VL CDR sequences selected from the group consisting of those combinations shown in Table 18, and/or a combination of VH CDR sequences selected from the group consisting of those combinations shown in Table 18. In some embodiments, the activatable anti-CD3ε antibody includes a combination of heavy chain CDR sequences selected from the group consisting of the combinations shown in Group R in Table 18. In some embodiments, the activatable anti-CD3ε antibody includes a combination of light chain CDR sequences selected from the group consisting of the combinations shown in Group R in Table 18. In some embodiments, the activatable anti-CD3ε antibody includes a combination of heavy chain CDR sequences selected from the group consisting of the combinations shown in Group S in Table 18. In some embodiments, the activatable anti-CD3ε antibody includes a combination of light chain CDR sequences selected from the group consisting of the combinations shown in Group S in Table 18. In some embodiments, the activatable anti-CD3ε antibody includes a combination of heavy chain CDR sequences selected from the group consisting of the combinations shown in Group T in Table 18. In some embodiments, the activatable anti-CD3ε antibody includes a combination of light chain CDR sequences selected from the group consisting of the combinations shown in Group T in Table 18. In some embodiments, the activatable anti-CD3ε antibody includes a combination of heavy chain CDR sequences selected from the group consisting of the combinations shown in Group U in Table 18. In some embodiments, the activatable anti-CD3ε antibody includes a combination of light chain CDR sequences selected from the group consisting of the combinations shown in Group U in Table 18. In some embodiments, the activatable anti-CD3ε antibody includes a combination of heavy chain CDR sequences selected from the group consisting of the combinations shown in Group V in Table 18. In some embodiments, the activatable anti-CD3ε antibody includes a combination of light chain CDR sequences selected from the group consisting of the combinations shown in Group V in Table 18. In some embodiments, the activatable anti-CD3ε antibody includes a combination of heavy chain CDR sequences selected from the group consisting of the combinations shown in Group W in Table 18. In some embodiments, the activatable anti-CD3ε antibody includes a combination of light chain CDR sequences selected from the group consisting of the combinations shown in Group W in Table 18. In some embodiments, the activatable anti-CD3ε antibody includes a combination of heavy chain CDR sequences selected from the group consisting of the combinations shown in Group X in Table 18. In some embodiments, the activatable anti-CD3ε antibody includes a combination of light chain CDR sequences selected from the group consisting of the combinations shown in Group X in Table 18.

TABLE 18

Additional CDR Sequences for Antibodies and Activatable Antibodiesth at BindCD38

Group R

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| TLSSGNIENYVH (784) | DDDKRPD (785) | HSYVSSFNV (786) | SFPMA (787) | TISTSGGRTYYR DSVKG (788) | FRQYSGGFDY (789) |

Group S

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| TLSSGNIE NNYVH (790) | DDDKRPD (785) | HSYVSSFNV (786) | SFPMA (787) | TISTSGG RTYYRDS VKG (788) | FRQYSGGFDY (789) |

Group T

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| GFTFNTYA (791) | IRSKYNNYAT (792) | VRHGNFGNSYV SWFAY (793) | TGAVTTSNY (794) | GTN (795) | ALWYSNLWV (58) |

Group U

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| RYTMH (796) | YINPSRGYTNYNQKFK D (797) | YDDDHYSLDY (798) | SASSSVSYMN (799) | DTSKLAS (800) | QQWSSNPFT (801) |

Group V

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| SYGMH (802) | VISYDGSNKYYADSVK G (803) | LSPYCTNGVCW DAFDI (804) | RASQTISNYLN (805) | AASTLQS (806) | QQFNSYPRT (807) |
| DYAMS (808) | FIRSKAYGGTTEYAAS VKG (809) | QLWLLQDAFDI (810) | RASQGISNYLA (811) | AASTLQS (806) | QQSYSTPPT (812) |
| SRNWWS (813) | DIYHSGSTNYNPSLKS (814) | GYTSCRDAFDI (815) | RASQGIGNYLA (816) | WASIRES (817) | QQYYSNPQT (818) |
| GYYWS (819) | EINHSGSTNYNPSLKS (820) | GRGRFLGWLLG GSNWFDP (821) | RASQGISNYLN (822) | DASNLET (823) | QQSYSTPYT (824) |
| GYYWS (819) | EINHSGSTNYNPSLKS (820) | GPDRMGHGFDI (825) | RASQSISSYLN (826) | AASSLQS (92) | QQSYSSP (827) |
| SNSAAWN (828) | RTYYRSKWYNDYAVSV KS (829) | DRRRIAARQYY GMDV (830) | RASQSVSSNYLA (831) | GASSRAT (832) | QKYNSAP (833) |
| SYAMG (834) | AVSGSGGSTYYADSVK G (835) | AKFLGHYYGMD V (836) | RASQSISSYLN (826) | AASSLQS (92) | LQHNAYPYT (837) |
| NPRMGVS (838) | HIFPSDAKAHSASLKS (839) | ILGEYYPPAWF DP (840) | KSSQSVLYSSNNKN YLA (841) | WASTRES (842) | QQYLKIPYT (843) |

Group W

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| IYAMN (844) | RIRSKYNNYATYYADS VKS (845) | HGNFGNSYVSF FAY (846) | GSSTGAVTSGYYPN (847) | GTKFLAP (848) | ALWYSNRWV (849) |

TABLE 18 -continued

Additional CDR Sequences for Antibodies and Activatable Antibodiesth at BindCD38

| | | | | | |
|---|---|---|---|---|---|
| KYAMN (850) | RIRSKYNNYATYYADS VKD (54) | HGNFGNSYISY WAY (851) | RSSTGAVTSGYYPN (852) | ATDMRPS (853) | ALWYSNRWV (849) |
| SYAMN (854) | RIRSKYNNYATYYADS VKG (855) | HGNFGNSYLSF WAY (856) | GSSTGAVTSGNYPN (857) | GTKFLAP (848) | VLWYSNRWV (858) |
| RYAMN (859) | RIRSKYNNYATYYADS VKG (855) | HGNFGNSYLSY FAY (860) | | | |
| VYAMN (861) | RIRSKYNNYATYYADS VKK (862) | HGNFGNSYLSW WAY (863) | | | |
| KYAMN (850) | RIRSKYNNYATYYADS VKS (845) | HGNFGNSYISY YAY (864) | | | |
| GYAMN (865) | RIRSKYNNYATYYADS VKE (866) | HRNFGNSYLSW FAY (867) | | | |
| VYAMN (861) | RIRSKYNNYATYYADS VKK (862) | HGNFGNSYISW WAY (868) | | | |
| SYAMN (854) | RIRSKYNNYATYYADS VKG (855) | HGNFGNSYVSW WAY (869) | | | |
| KYAMN (850) | RIRSKYNNYATYYADS VKD (54) | HGNFGNSYISY WAY (851) | | | |
| IYAMN (844) | RIRSKYNNYATYYADS VKS (845) | HGNFGNSYLSF FAY (846) | | | |
| KYAMN (850) | RIRSKYNNYATYYADS VKD (54) | HGNFGNSYISY WAY (851) | | | |
| SYAMN (854) | RIRSKYNNYATYYADS VKG (855) | HGNFGNSYLSF WAY (856) | | | |
| | | | GSSTGAVTSGYYPN (847) | GTKFLAP (848) | ALWYSNRWV (849) |
| | | | RSSTGAVTSGYYPN (852) | ATDMRPS (853) | ALWYSNRWV (849) |
| | | | GSSTGAVTSGNYPN (857) | GTKFLAP (848) | VLWYSNRWV (858) |

Group X

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| GYGMH (870) | VIWYDGSKKYYVDSVK G (871) | QMGYWHFDL (872) | RASQSVSSYLA (873) | DASNRAT (874) | QQRSNWPPLT (875) |
| SYGMH (802) | IIWYDGSKKNYADSVK G (872) | GTGYNWFDP (873) | RASQSVSSSYLA (874) | GASSRAT (832) | QQYGSSPIT (875) |
| SYGMH (802) | IIWYDGSKKNYADSVK G (872) | GTGYNWFDP (873) | RASQGISSALA (876) | YASSLQS (877) | QQYYSTLTF (888) |
| SYGMH (802) | IIWYDGSKKNYADSVK G (872) | GTGYNWFDP (873) | RASQGISSALA (876) | DASSLGS (889) | QQYYSTLTF (888) |
| SYGMH (802) | IIWYDGSKKNYADSVK G (872) | GTGYNWFDP (873) | WASQGISSYLA (890) | YASSLQS (877) | QQYYSTLTF (888) |
| SYGMH (802) | AIWYNGRKQDYADSVK G (891) | GTGYNWFDP (873) | RASQSVSSYLA (873) | DASNRAT (874) | QQRSNWPWT (892) |
| SYGMH (802) | AIWYNGRKQDYADSVK G (891) | GTGYNWFDP (873) | RASQGISSALA (876) | DASSLES (893) | QQFNSYPIT (894) |

The ABs in the multispecific activatable antibodies of the disclosure specifically bind at least a mammalian target. In some embodiments, such ABs bind mammalian CD3ε. In some embodiments, such ABs bind a human target. In some embodiments, such ABs bind a non-human primate target. Also included in the disclosure are ABs that bind to the same epitope as an antibody of the disclosure and/or an activated activatable antibody described herein. Also included in the disclosure are ABs that compete with an antibody and/or an activated activatable antibody described herein for binding to a target, e.g., a human target. Also included in the disclosure are ABs that cross-compete with an antibody and/or an activated activatable antibody described herein for binding to a target, e.g., a human target.

In some embodiments, the ABs in the multispecific activatable antibodies of the disclosure specifically bind at least a CD3ε target, such as, for example, mammalian CD3ε. In some embodiments, such ABs bind mammalian CD3ε. In some embodiments, such ABs bind human CD3ε. In some embodiments, such ABs bind non-human primate CD3ε.

Also included in the disclosure are ABs that bind to the same CD3ε epitope as an antibody of the disclosure and/or an activated activatable antibody described herein. Also included in the disclosure are ABs that compete with an anti-CD3ε antibody and/or an activated anti-CD3ε activatable antibody described herein for binding to a CD3ε target, e.g., human CD3ε. Also included in the disclosure are ABs that cross-compete with an anti-CD3ε antibody and/or an activated anti-CD3ε activatable antibody described herein for binding to a CD3ε target, e.g., human CD3ε.

In some embodiments, at least one of the AB of the multispecific antibody and/or multispecific activatable antibody binds Epidermal Growth Factor Receptor (EGFR). In some embodiments, the AB that binds EGFR includes one or more of the heavy chain and/or light chain sequences shown below.

C225v5 Antibody Heavy Chain Nucleotide Sequence:
(SEQ ID NO: 100)
CAGGTGCAGCTGAAACAGAGCGGCCCGGGCCTGGTGCAGCCGAGCCAGAGCCTGAGCATTACCTGCACCGTGAGCGG

CTTTAGCCTGACCAACTATGGCGTGCATTGGGTGCGCCAGAGCCCGGGCAAAGGCCTGGAATGGCTGGGCGTGATTT

GGAGCGGCGGCAACACCGATTATAACACCCCGTTTACCAGCCGCCTGAGCATTAACAAAGATAACAGCAAAAGCCAG

GTGTTTTTTAAAATGAACAGCCTGCAAAGCCAGGATACCGCGATTTATTATTGCGCGCGCGCGCTGACCTATTATGA

TTATGAATTTGCGTATTGGGGCCAGGGCACCCTGGTGACCGTGAGCGCGGCTAGCACCAAGGGCCCATCGGTCTTCC

CCCTGGCACCCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCCCTGACCAGCGGCGTGCACACCTTCCCGGCTGTCCTACAGTCCTCAGG

ACTCTACTCCCTCAGCAGCGTGGTGACCGTGCCCTCCAGCAGCTTGGGCACCCAGACCTACATCTGCAACGTGAATC

ACAAGCCCAGCAACACCAAGGTGGACAAGAAAGTTGAGCCCAAATCTTGTGACAAAACTCACACATGCCCACCGTGC

CCAGCACCTGAACTCCTGGGGGGACCGTCAGTCTTCCTCTTCCCCCCAAAACCCAAGGACACCCTCATGATCTCCCG

GACCCCTGAGGTCACATGCGTGGTGGTGGACGTGAGCCACGAAGACCCTGAGGTCAAGTTCAACTGGTACGTGGACG

GCGTGGAGGTGCATAATGCCAAGACAAAGCCGCGGGAGGAGCAGTACAACAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCAT

CGAGAAAACCATCTCCAAAGCCAAAGGGCAGCCCCGAGAACCACAGGTGTACACCCTGCCCCCATCCCGGGATGAAC

TGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAA

GCTCACCGTGGACAAGAGCAGGTGGCAGCAGGGGAACGTCTTCTCATGCTCCGTGATGCATGAGGCTCTGCACAACC

ACTACACGCAGAAGAGCCTCTCCCTGTCTCCGGGTAAATGA

C225v5 Antibody Heavy Chain Amino Acid Sequence
(SEQ ID NO: 101)
QVQLKQSGPGLVQPSQSLSITCTVSGFSLTNYGVHWVRQSPGKGLEWLGVIWSGGNTDYNTPFTSRLSINKDNSKSQ

VFFKMNSLQSQDTAIYYCARALTYYDYEFAYWGQGTLVTVSAASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSRDELTKNQVSLTCLVKGFYPSDIAVEWES

NGQPENNYKTTPPVLDSDGSFFLYSKLTVDKSRWQQGNVFSCSVMHEALHNHYTQKSLSLSPGK*

C225v5 Antibody Light Chain Nucleotide Sequence:
(SEQ ID NO: 102)
CAGATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

```
GTGGAAAGCGAAGATATTGCGGATTATTATTGCCAGCAGAACAACAACTGGCCGACCACCTTTGGCGCGGGCACCAA

ACTGGAACTGAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

C225v5 Antibody Light Chain Amino Acid Sequence:
                                                              (SEQ ID NO: 103)
QILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLELKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

C225v4 Antibody Heavy Chain Nucleotide Sequence:
                                                              (SEQ ID NO: 104)
CAGGTGCAGCTGAAACAGAGCGGCCCGGGCCTGGTGCAGCCGAGCCAGAGCCTGAGCATTACCTGCACCGTGAGCGG

CTTTAGCCTGACCAACTATGGCGTGCATTGGGTGCGCCAGAGCCCGGGCAAAGGCCTGGAATGGCTGGGCGTGATTT

GGAGCGGCGGCAACACCGATTATAACACCCCGTTTACCAGCCGCCTGAGCATTAACAAAGATAACAGCAAAAGCCAG

GTGTTTTTTAAAATGAACAGCCTGCAAAGCAACGATACCGCGATTTATTATTGCGCGCGCGCGCTGACCTATTATGA

TTATGAATTTGCGTATTGGGGCCAGGGCACCCTGGTGACCGTGAGCGCGGCTAGCACCAAGGGCCCATCGGTCTTCC

CCCTGGCACCCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCCCTGACCAGCGGCGTGCACACCTTCCCGGCTGTCCTACAGTCCTCAGG

ACTCTACTCCCTCAGCAGCGTGGTGACCGTGCCCTCCAGCAGCTTGGGCACCCAGACCTACATCTGCAACGTGAATC

ACAAGCCCAGCAACACCAAGGTGGACAAGAAAGTTGAGCCCAAATCTTGTGACAAAACTCACACATGCCCACCGTGC

CCAGCACCTGAACTCCTGGGGGGACCGTCAGTCTTCCTCTTCCCCCCAAAACCCAAGGACACCCTCATGATCTCCCG

GACCCCTGAGGTCACATGCGTGGTGGTGGACGTGAGCCACGAAGACCCTGAGGTCAAGTTCAACTGGTACGTGGACG

GCGTGGAGGTGCATAATGCCAAGACAAAGCCGCGGGAGGAGCAGTACAACAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCAT

CGAGAAAACCATCTCCAAAGCCAAAGGGCAGCCCCGAGAACCACAGGTGTACACCCTGCCCCCATCCCGGGATGAAC

TGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAA

GCTCACCGTGGACAAGAGCAGGTGGCAGCAGGGGAACGTCTTCTCATGCTCCGTGATGCATGAGGCTCTGCACAACC

ACTACACGCAGAAGAGCCTCTCCCTGTCTCCGGGTAAATGA

C225v4 Antibody Heavy Chain Amino Acid Sequence:
                                                              (SEQ ID NO: 105)
QVQLKQSGPGLVQPSQSLSITCTVSGFSLTNYGVHWVRQSPGKGLEWLGVIWSGGNTDYNTPFTSRLSINKDNSKSQ

VFFKMNSLQSNDTAIYYCARALTYYDYEFAYWGQGTLVTVSAASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSRDELTKNQVSLTCLVKGFYPSDIAVEWES

NGQPENNYKTTPPVLDSDGSFFLYSKLTVDKSRWQQGNVFSCSVMHEALHNHYTQKSLSLSPGK*

C225v6 Antibody Heavy Chain Nucleotide Sequence:
                                                              (SEQ ID NO: 106)
CAGGTGCAGCTGAAACAGAGCGGCCCGGGCCTGGTGCAGCCGAGCCAGAGCCTGAGCATTACCTGCACCGTGAGCGG

CTTTAGCCTGACCAACTATGGCGTGCATTGGGTGCGCCAGAGCCCGGGCAAAGGCCTGGAATGGCTGGGCGTGATTT

GGAGCGGCGGCAACACCGATTATAACACCCCGTTTACCAGCCGCCTGAGCATTAACAAAGATAACAGCAAAAGCCAG

GTGTTTTTTAAAATGAACAGCCTGCAAAGCCAGGATACCGCGATTTATTATTGCGCGCGCGCGCTGACCTATTATGA
```

-continued

```
TTATGAATTTGCGTATTGGGGCCAGGGCACCCTGGTGACCGTGAGCGCGGCTAGCACCAAGGGCCCATCGGTCTTCC

CCCTGGCACCCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCCCTGACCAGCGGCGTGCACACCTTCCCGGCTGTCCTACAGTCCTCAGG

ACTCTACTCCCTCAGCAGCGTGGTGACCGTGCCCTCCAGCAGCTTGGGCACCCAGACCTACATCTGCAACGTGAATC

ACAAGCCCAGCAACACCAAGGTGGACAAGAAAGTTGAGCCCAAATCTTGTGACAAAACTCACACATGCCCACCGTGC

CCAGCACCTGAACTCCTGGGGGGACCGTCAGTCTTCCTCTTCCCCCCAAAACCCAAGGACACCCTCATGATCTCCCG

GACCCCTGAGGTCACATGCGTGGTGGTGGACGTGAGCCACGAAGACCCTGAGGTCAAGTTCAACTGGTACGTGGACG

GCGTGGAGGTGCATAATGCCAAGACAAAGCCGCGGGAGGAGCAGTACGCCAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCAT

CGAGAAAACCATCTCCAAAGCCAAAGGGCAGCCCCGAGAACCACAGGTGTACACCCTGCCCCCATCCCGGGATGAAC

TGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAA

GCTCACCGTGGACAAGAGCAGGTGGCAGCAGGGGAACGTCTTCTCATGCTCCGTGATGCATGAGGCTCTGCACAACC

ACTACACGCAGAAGAGCCTCTCCCTGTCTCCGGGTAAATGA]
```

C225v6 Antibody Heavy Chain Amino Acid Sequence
(SEQ ID NO: 107)
QVQLKQSGPGLVQPSQSLSITCTVSGFSLTNYGVHWVRQSPGKGLEWLGVIWSGGNTDYNTPFTSRLSINKDNSKSQ

VFFKMNSLQSQDTAIYYCARALTYYDYEFAYWGQGTLVTVSAASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYASTYRVVSVL

TVLHQDWLNGKEYKCKVSNKALPAPIEKTISKAKGQPREPQVYTLPPSRDELTKNQVSLTCLVKGFYPSDIAVEWES

NGQPENNYKTTPPVLDSDGSFFLYSKLTVDKSRWQQGNVFSCSVMHEALHNHYTQKSLSLSPGK*

C225Antibody Heavy Chain Amino Acid Sequence
(SEQ ID NO: 523)
QVQLKQSGPGLVQPSQSLSITCTVSGFSLTNYGVHWVRQSPGKGLEWLGVIWSGGNTDYNTPFTSRLSINKDNSKSQ

VFFKMNSLQSQDTAIYYCARALTYYDYEFAYWGQGTLVTVSAASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYQSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK*

In some embodiments, at least one of the AB of the multispecific antibody and/or multispecific activatable antibody binds interleukin 6 receptor (IL-6R). In some embodiments, the AB that binds IL-6R includes one or more of the heavy chain and/or light chain sequences shown below.

Av1 Antibody Heavy Chain Amino Acid Sequence:
(SEQ ID NO: 108)
QVQLQESGPGLVRPSQTLSLTCTVSGYSITSDHAWSWVRQPPGRGLEWIGYISYSGITTYNPSLKSRVTISRDNSKN

TLYLQMNSLRAEDTAVYYCARSLARTTAMDYWGQSLVTVSSASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK

Av1 Antibody Light Chain Amino Acid Sequence:
(SEQ ID NO: 109)
DIQMTQSPSSLSASVGDRVTITCRASQDISSYLNWYQQKPGKAPKLLIYYTSRLHSGVPSRFSGSGSGTDFTFTISS

LQPEDIATYYCQQGNTLPYTFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC

In some embodiments, the AB binds a Jagged target, e.g., Jagged 1, Jagged 2 or both Jagged 1 and Jagged 2. In some embodiments, the AB that binds a Jagged target includes one or more of the heavy chain and/or light chain sequences shown below.

4D11 Light Chain sequence:
(SEQ ID NO: 110)
DIQMTQSPSSLSASVGDRVTITCRASQSISSYLNWYQQKPGKAPKLLIYAASSLQSGVPSRFSGSGSGTDFTLTISS

LQPEDFATYYCQQTVVAPPLFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC

4D11 Heavy Chain sequence:
(SEQ ID NO: 111)
EVQLLESGGGLVQPGGSLRLSCAASGFTFSSYAMSWVRQAPGKGLEWVSSIDPEGRQTYYADSVKGRFTISRDNSKN

TLYLQMNSLRAEDTAVYYCAKDIGGRSAFDYWGQGTLVTVSSASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK

4D11v2 Heavy Chain sequence
(SEQ ID NO: 112)
EVHLLESGGGLVQPGGSLRLSCAASGFTFSSYAMSWVRQAPGKGLEWVSSIDPEGRQTYYADSVKGRFTISRDNSKN

TLYLQMNSLRAEDTAVYYCAKDIGGRSAFDYWGQGTLVTVSSASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK

4D11v2 Light Chain Sequence
(SEQ ID NO: 113)
DIQMTQSPSSLSASVGDRVTITCRASQSISSYLNWYQQKPGKAPKLLIYAASSLQSGVPSRFSGSGSGTDFTLTISS

LQPEDFATYYCQQTVVAPPLFGQGTKVEIKRTVAAPSVFIFPPSDEQLKSGTASVVCLLNNFYPREAKVQWKVDNAL

QSGNSQESVTEQDSKDSTYSLSSTLTLXKADYEKHKVYACEVTHQGLSSPVTKSFNRGEC

In some embodiments, at least one of the AB of the multispecific antibody and/or multispecific activatable antibody a Jagged target and includes one or more of the variable heavy chain and/or variable light chain sequences shown below.

Variable Light Chain Amino Sequence Lc4
(SEQ ID NO: 114)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

-continued

Variable Heavy Chain Amino Sequence Hc4
(SEQ ID NO: 115)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKDIGGRSAFDYWGQGTLVTVSS

Variable Light Chain Amino Sequence Lc5
(SEQ ID NO: 116)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc5
(SEQ ID NO: 117)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPYHGQFDYWGQGTLVTVSS

Variable Light Chain Amino Sequence Lc7
(SEQ ID NO: 118)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc7
(SEQ ID NO: 119)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPFFGQFDYWGQGTLVTVSS

Variable Light Chain Amino Sequence Lc8
(SEQ ID NO: 120)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc8
(SEQ ID NO: 121)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKHIGRTNPFDYWGQGTLVTVSS

Variable Light Chain Amino Sequence Lc13
(SEQ ID NO: 122)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc13
(SEQ ID NO: 123)
EVQLLESGGGLVQPGGSLRLSCAASGFTFSSYAMSWVRQAPGKGLEWVSSIEQMGWQTEYADSVKGRFTISRDNSKN

TLYLQMNSLRAEDTAVYYCAKSAAAFDYWGQGTLVTVSS

Variable Light Chain Amino Sequence Lc16
(SEQ ID NO: 124)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc16
(SEQ ID NO: 125)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPYYGQFDYWGQGTLVTVSS

Variable Light Chain Amino Sequence Lc19
(SEQ ID NO: 126)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc19
(SEQ ID NO: 127)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPFFGQFDYWGQGTLVTVSS

-continued

Variable Light Chain Amino Sequence Lc21
(SEQ ID NO: 128)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc21
(SEQ ID NO: 129)
EVQLLESGGGLVQPGGSLRLSCAASGFTFSSYAMSWVRQAPGKGLEWVSSIEQMGWQTYYADSVKGRFTISRDNSKN
TLYLQMNSLRAEDTAVYYCAKDIGGRSAFDYWGQGTLVTVSS Variable Light Chain Amino Sequence Lc24
(SEQ ID NO: 130)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc24
(SEQ ID NO: 131)
EVQLLESGGGLVQPGGSLRLSCAASGFTFSSYAMSWVRQAPGKGLEWVSSIEEMGWQTLYADSVKGRFTISRDNSKN
TLYLQMNSLRAEDTAVYYCAKSAAAFDYWGQGTLVTVSS Variable Light Chain Amino Sequence Lc26
(SEQ ID NO: 132)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc26
(SEQ ID NO: 133)
EVQLLESGGGLVQPGGSLRLSCAASGFTFSSYAMSWVRQAPGKGLEWVSSIEQMGWQTYYADSVKGRFTISRDNSKN
TLYLQMNSLRAEDTAVYYCAKDIGGRSAFDYWGQGTLVTVSS Variable Light Chain Amino Sequence Lc27
(SEQ ID NO: 134)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc27
(SEQ ID NO: 135)
EVQLLESGGGLVQPGGSLRLSCAASGFTFSSYAMSWVRQAPGKGLEWVSSIEQMGWQTYYADSVKGRFTISRDNSKN
TLYLQMNSLRAEDTAVYYCAKSPPFYGQFDYWGQGTLVTVSS Variable Light Chain Amino Sequence Lc28
(SEQ ID NO: 136)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc28
(SEQ ID NO: 137)
EVQLLESGGGLVQPGGSLRLSCAASGFTFSSYAMSWVRQAPGKGLEWVSSIEQMGWQTYYADSVKGRFTISRDNSKN
TLYLQMNSLRAEDTAVYYCAKSPPFFGQFDYWGQGTLVTVSS Variable Light Chain Amino Sequence Lc30
(SEQ ID NO: 138)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR Variable Heavy Chain Amino Sequence Hc30
(SEQ ID NO: 139)
EVQLLESGGGLVQPGGSLRLSCAASGFTFSSYAMSWVRQAPGKGLEWVSSIEEMGWQTLYADSVKGRFTISRDNSKN
TLYLQMNSLRAEDTAVYYAKSAAAFDYWGQGTLVTVSS Variable Light Chain Amino Sequence Lc31
(SEQ ID NO: 140)
DIQMTQSPSSLSASVGDRVTITCRASQSISSYLNWYQQKPGKAPKLLIYAASSLQSGVPSRFSGSGSGTDFTLTISS
LQPEDFATYYCQQSVVAPLTFGQGTKVEIKR

```
Variable Heavy Chain Amino Sequence Hc31
                                                           (SEQ ID NO: 141)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKDIGGRSAFDYWGQGTLVTVSS

Variable Light Chain Amino Sequence Lc32
                                                           (SEQ ID NO: 142)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc32
                                                           (SEQ ID NO: 143)
EVQLLESGGGLVQPGGSLRLSCAASGFTFSSYAMSWVRQAPGKGLEWVSSIDPEGWQTYYADSVKGRFTISRDNSKN

TLYLQMNSLRAEDTAVYYCAKSAAAFDYWGQGTLVTVSS

Variable Light Chain Amino Sequence Lc37
                                                           (SEQ ID NO: 144)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc37
                                                           (SEQ ID NO: 145)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPHNGQFDYWGQGTLVTVSS

Variable Light Chain Amino Sequence Lc39
                                                           (SEQ ID NO: 146)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc39
                                                           (SEQ ID NO: 147)
EVQLLESGGGLVQPGGSLRLSCAASGFTFSSYAMSWVRQAPGKGLEWVSSIEQMGWQTEYADSVKGRFTISRDNSKN

TLYLQMNSLRAEDTAVYYCAKSAAAFDYWGQGTLVTVSS

Variable Light Chain Amino Sequence Lc40
                                                           (SEQ ID NO: 148)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Heavy Chain Amino Sequence Hc40
                                                           (SEQ ID NO: 149)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKSPPFFGQFDYWGQGTLVTVSS

Variable Light Chain Amino Sequence Lc47
                                                           (SEQ ID NO: 150)
DIQMTQSPSSLSASVGDRVTITCRASQSISSYLNWYQQKPGKAPKLLIYAASSLQSGVPSRFSGSGSGTDFTLTISS

LQPEDFATYYCQQSVVAPLTFGQGTKVEIKR

Variable Heavy Chain Amino Sequence Hc47
                                                           (SEQ ID NO: 151)
EVQLLESGGGLVQPGGSLRLSCAASGFTFSSYAMSWVRQAPGKGLEWVSSIDEMGWQTEYADSVKGRFTISRDNSKN

TLYLQMNSLRAEDTAVYYCAKSAAAFDYWGQGTLVTVSS

Variable 4B2 Light Chain
                                                           (SEQ ID NO: 152)
DIQMTQSPSSLSASVGDRVTITCRASQSISSYLNWYQQKPGKAPKLLIYAASSLQSGVPSRFSGSGSGTDFTLTISS

LQPEDFATYYCQQTLDAPPQFGQGTKVEIKR

Variable 4B2 Heavy Chain
                                                           (SEQ ID NO: 153)
EVQLLESGGGLVQPGGSLRLSCAASGFTFSSYAMSWVRQAPGKGLEWVSSIEQMGWQTYYADSVKGRFTISRDNSKN

TLYLQMNSLRAEDTAVYYCAKDIGGRSAFDYWGQGTLVTVSS
```

```
Variable 4D11 Light Chain
                                                        (SEQ ID NO: 154)
DIQMTQSPSSLSASVGDRVTITCRASQSISSYLNWYQQKPGKAPKLLIYAASSLQSGVPSRFSGSGSGTDFTLTISS

LQPEDFATYYCQQTVVAPPLFGQGTKVEIKR

Variable 4D11 Heavy Chain
                                                        (SEQ ID NO: 155)
EVQLLESGGGLVQPGGSLRLSCAASGFTFSSYAMSWVRQAPGKGLEWVSSIDPEGRQTYYADSVKGRFTISRDNSKN

TLYLQMNSLRAEDTAVYYCAKDIGGRSAFDYWGQGTLVTVSS

Variable 4E7 Light Chain
                                                        (SEQ ID NO: 156)
DIQMTQSPSSLSASVGDRVTITCRASQSISSYLNWYQQKPGKAPKLLIYAASSLQSGVPSRFSGSGSGTDFTLTISS

LQPEDFATYYCQQSLVAPLTFGQGTKVEIKR

Variable 4E7 Heavy Chain
                                                        (SEQ ID NO: 157)
EVQLLESGGGLVQPGGSLRLSCAASGFTFSSYAMSWVRQAPGKGLEWVSSIEEMGWQTKYADSVKGRFTISRDNSKN

TLYLQMNSLRAEDTAVYYCAKSAAAFDYWGQGTLVTVSS

Variable 4E11 Light Chain
                                                        (SEQ ID NO: 158)
DIQMTQSPSSLSASVGDRVTITCRASQSISSYLNWYQQKPGKAPKLLIYAASSLQSGVPSRFSGSGSGTDFTLTISS

LQPEDFATYYCQQALDAPLMFGQGTKVEIKR

Variable 4E11 Heavy Chain
                                                        (SEQ ID NO: 159)
EVQLLESGGGLVQPGGSLRLSCAASGFTFSSYAMSWVRQAPGKGLEWVSSIEPMGQLTEYADSVKGRFTISRDNSKN

TLYLQMNSLRAEDTAVYYCAKDIGGRSAFDYWGQGTLVTVSS

Variable 6B7 Light Chain
                                                        (SEQ ID NO: 160)
DIQMTQSPSSLSASVGDRVTITCRASQSISSYLNWYQQKPGKAPKLLIYAASSLQSGVPSRFSGSGSGTDFTLTISS

LQPEDFATYYCQQALVAPLTFGQGTKVEIKR

Variable 6B7 Heavy Chain
                                                        (SEQ ID NO: 161)
EVQLLESGGGLVQPGGSLRLSCAASGFTFSSYAMSWVRQAPGKGLEWVSSIDEMGWQTYYADSVKGRFTISRDNSKN

TLYLQMNSLRAEDTAVYYCAKSAAAFDYWGQGTLVTVSS

Variable 6F8 Light Chain
                                                        (SEQ ID NO: 162)
DIQMTQSPSSLSASVGDRVTITCRASQSISSYLNWYQQKPGKAPKLLIYAASSLQSGVPSRFSGSGSGTDFTLTISS

LQPEDFATYYCQQALVAPLTFGQGTKVEIKR

Variable 6F8 Heavy Chain
                                                        (SEQ ID NO: 163)
EVQLLESGGGLVQPGGSLRLSCAASGFTFSSYAMSWVRQAPGKGLEWVSSIDEMGWQTYYADSVKGRFTISRDNSKN

TLYLQMNSLRAEDTAVYYCAKSAAAFDYWGQGTLVTVSS
```

Antibodies and/or activatable antibodies of the disclosure specifically bind a given target, e.g., a human target protein such as human CD3ε. Also included in the disclosure are anti-CD3ε antibodies, activatable antibodies, multispecific antibodies and/or multispecific activatable antibodies that bind to the same epitope as the anti-CD3ε antibodies, activatable antibodies, multispecific antibodies and/or multispecific activatable antibodies described herein. Also included in the disclosure are anti-CD3ε antibodies, activatable antibodies, multispecific antibodies and/or multispecific activatable antibodies that compete with an anti-CD3ε antibody, activatable antibody, multispecific antibody and/or multispecific activatable antibody described herein for binding to CD3ε, e.g., human CD3ε. Also included in the disclosure are anti-CD3ε antibodies, activatable antibodies, multispecific antibodies and/or multispecific activatable antibodies that cross-compete with an anti-CD3ε antibody, activatable antibody, multispecific antibody and/or multispecific activatable antibody described herein for binding to CD3ε, e.g., human CD3ε.

Those skilled in the art will recognize that it is possible to determine, without undue experimentation, if an anti-CD3ε antibody, an anti-CD3ε activatable antibody, a multispecific antibody and/or a multispecific activatable antibody has the same or similar specificity as an anti-CD3ε antibody, an anti-CD3ε activatable antibody, a multispecific antibody and/or multispecific activatable antibody of the disclosure by ascertaining whether the former prevents the latter from binding to a target. If the anti-CD3ε antibody, the anti-CD3ε activatable antibody, multispecific antibody and/or a multispecific antibody being tested competes with the anti-CD3ε antibody, the anti-CD3ε activatable antibody, the multispecific antibody and/or a multispecific activatable antibody of the disclosure, as shown by a decrease in binding by the anti-CD3ε antibody, the anti-CD3ε activatable antibody, the multispecific antibody and/or a multispecific activatable antibody of the disclosure, then the anti-CD3ε antibody, the anti-CD3ε activatable antibody, the two multispecific antibodies and/or multispecific activatable antibodies bind to the same, or a closely related, epitope.

One embodiment for determining whether an anti-CD3ε antibody, an anti-CD3ε activatable antibody, a multispecific antibody and/or a multispecific activatable antibody has the same or similar specificity as an anti-CD3ε antibody, an anti-CD3ε activatable antibody, a multispecific antibody and/or a multispecific activatable antibody of the disclosure is to pre-incubate the anti-CD3ε antibody, the anti-CD3ε activatable antibody, the multispecific antibody and/or a multispecific activatable antibody of the disclosure with soluble target with which it is normally reactive, and then add the anti-CD3ε antibody, the anti-CD3ε activatable antibody, the multispecific antibody and/or a multispecific activatable antibody being tested to determine if the anti-CD3ε antibody, the anti-CD3ε activatable antibody, the multispecific antibody and/or a multispecific activatable antibody being tested is inhibited in its ability to bind the target. If the anti-CD3ε antibody, the anti-CD3ε activatable antibody, the multispecific antibody and/or a multispecific activatable antibody being tested is inhibited then, in all likelihood, it has the same, or functionally equivalent, epitopic specificity as the anti-CD3ε antibody, the anti-CD3ε activatable antibody, the multispecific antibody and/or a multispecific activatable antibody of the disclosure.

An anti-CD3ε antibody, an anti-CD3ε activatable antibody, multispecific antibody and/or a multispecific activatable antibody is generated, for example, using the procedures described in the Examples provided below. An anti-CD3ε antibody, an anti-CD3ε activatable antibody, multispecific antibody and/or a multispecific activatable antibody can also be generated using any of a number of art-recognized techniques for antibody production and/or purification.

Antibody fragments, such as Fv, F(ab')$_2$ and Fab, for use in an anti-CD3ε antibody, an anti-CD3ε activatable antibody, a multispecific antibody and/or a multispecific activatable antibody may be prepared by cleavage of the intact protein, e.g., by protease or chemical cleavage. In some embodiments, a truncated gene is designed. For example, a chimeric gene encoding a portion of the F(ab')$_2$ fragment would include DNA sequences encoding the CH1 domain and hinge region of the H chain, followed by a translational stop codon to yield the truncated molecule.

Expression vectors include plasmids, retroviruses, YACs, EBV derived episomes, and the like. A convenient vector is one that encodes a functionally complete human CH or CL immunoglobulin sequence, with appropriate restriction sites engineered so that any VH or VL sequence can be easily inserted and expressed. In such vectors, splicing usually occurs between the splice donor site in the inserted J region and the splice acceptor site preceding the human C region, and also at the splice regions that occur within the human CH exons. Polyadenylation and transcription termination occur at native chromosomal sites downstream of the coding regions. The resulting antibody may be joined to any strong promoter, including retroviral LTRs, e.g., SV-40 early promoter, (Okayama et al. Mol. Cell. Bio. 3:280 (1983)), Rous sarcoma virus LTR (Gorman et al. P.N.A.S. 79:6777 (1982)), and moloney murine leukemia virus LTR (Grosschedl et al. Cell 41:885 (1985)). Also, as will be appreciated, native Ig promoters and the like may be used.

Further, anti-CD3ε antibodies, anti-CD3ε activatable antibodies, multispecific antibodies and/or multispecific activatable antibodies can be generated through display type technologies, including, without limitation, phage display, retroviral display, ribosomal display, and other techniques, using techniques well known in the art and the resulting molecules can be subjected to additional maturation, such as affinity maturation, as such techniques are well known in the art. Wright et al. Crit, Reviews in Immunol. 12125-168 (1992), Hanes and Pluckthun PNAS USA 94:4937-4942 (1997) (ribosomal display), Parmley and Smith Gene 73:305-318 (1988) (phage display), Scott, TIBS, vol. 17:241-245 (1992), Cwirla et al. PNAS USA 87:6378-6382 (1990), Russel et al. Nucl. Acids Research 21:1081-1085 (1993), Hoganboom et al. Immunol. Reviews 130:43-68 (1992), Chiswell and McCafferty TIBTECH; 10:80-8A (1992), and U.S. Pat. No. 5,733,743.

It can be desirable to modify the anti-CD3ε antibody, the anti-CD3ε activatable antibody, the multispecific antibody and/or multispecific activatable antibody of the disclosure with respect to effector function, so as to enhance or reduce such function to improve the effectiveness of the antibody in recruiting CD3$^+$ cells to one or more targets that are associated with a disease to be treated, such as, e.g. targets that are expressed on tumor cells. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). (See Caron et al., J. Exp Med., 176: 1191-1195 (1992) and Shopes, J. Immunol., 148: 2918-2922 (1992)). In some embodiments, an antibody can be engineered that has dual Fc regions and can thereby have enhanced complement lysis and ADCC capabilities. (See Stevenson et al., Anti-Cancer Drug Design, 3: 219-230 (1989)). In some embodiments, Fc mutations are made to remove glycosylation sites, thereby reducing Fc function.

Activatable Antibodies and Multispecific Activatable Antibodies

The activatable antibodies provided herein contain an antibody or antibody fragment thereof (collectively referred to as AB throughout the disclosure) that specifically binds a target and/or a epitope, wherein the AB is modified by a masking moiety (MM). The multispecific activatable antibodies provided herein contain at least a first antibody or antibody fragment thereof (collectively referred to as AB1 throughout the disclosure) that specifically binds a first target and/or a first epitope and a second antibody or antibody fragment thereof (collectively referred to as AB2 throughout the disclosure) that specifically binds a second target and/or a second epitope, wherein at least one of the AB is modified by a masking moiety (MM). In some embodiments, each AB in a multispecific activatable antibody is modified by its own masking moiety.

When the AB of an activatable antibody or at least one of the AB in a multispecific activatable antibody is modified with a MM and is in the presence of its target, specific binding of the AB to its target is reduced or inhibited, as compared to the specific binding of the AB not modified with an MM or the specific binding of the parental AB to the target.

The $K_d$ of the AB modified with a MM towards the target is at least 5, 10, 20, 25, 40, 50, 100, 250, 500, 1,000, 2,500, 5,000, 10,000, 50,000, 100,000, 500,000, 1,000,000, 5,000, 000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM or of the parental AB towards the target. Conversely, the binding affinity of the AB modified with a MM towards the target is at least 5, 10, 20, 25, 40, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM or of the parental AB towards the target.

The dissociation constant ($K_d$) of the MM towards the AB in the activatable antibody is generally greater than the $K_d$ of the AB towards the target. The dissociation constant ($K_d$) of the MM towards at least one of the AB in the multispecific activatable antibody is generally greater than the $K_d$ of the AB towards the target. The $K_d$ of the MM towards the AB can be at least 5, 10, 25, 50, 100, 250, 500, 1,000, 2,500, 5,000, 10,000, 100,000, 1,000,000 or even 10,000,000 times greater than the $K_d$ of the AB towards the target. Conversely, the binding affinity of the MM towards the AB is generally lower than the binding affinity of the AB towards the target. The binding affinity of MM towards the AB can be at least 5, 10, 25, 50, 100, 250, 500, 1,000, 2,500, 5,000, 10,000, 100,000, 1,000,000 or even 10,000,000 times lower than the binding affinity of the AB towards the target.

When the AB in the activatable antibody is modified with a MM and is in the presence of the target, specific binding of the AB to its target is reduced or inhibited, as compared to the specific binding of the AB not modified with an MM or the specific binding of the parental AB to the target. When at least one of the AB in the multispecific activatable antibody is modified with a MM and is in the presence of the target, specific binding of the AB to its target is reduced or inhibited, as compared to the specific binding of the AB not modified with an MM or the specific binding of the parental AB to the target. When compared to the binding of the AB not modified with an MM or the binding of the parental AB to the target, the AB's ability to bind the target when modified with an MM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or more when measured in vivo or in an in vitro assay.

The MM inhibits the binding of the AB in the activatable antibody to its target. The MM inhibits the binding of at least one of the AB in the multispecific activatable antibody to its target. The MM binds the antigen binding domain of the AB and inhibits binding of the AB to its target. The MM can sterically inhibit the binding of the AB to the target. The MM can allosterically inhibit the binding of the AB to its target. In these embodiments when the AB is modified or coupled to a MM and in the presence of target, there is no binding or substantially no binding of the AB to the target, or no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding of the AB to the target, as compared to the binding of the AB not modified with an MM, the parental AB, or the AB not coupled to an MM to the target, for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

When the AB in an activatable antibody is coupled to or modified by a MM, the MM 'masks' or reduces or otherwise inhibits the specific binding of the AB to its target. When the AB in an activatable antibody is coupled to or modified by a MM, such coupling or modification can effect a structural change that reduces or inhibits the ability of the AB to specifically bind its target.

When at least one of the AB in a multispecific activatable antibody is coupled to or modified by a MM, the MM 'masks' or reduces or otherwise inhibits the specific binding of the AB to its target. When at least one of the AB in a multispecific activatable antibody is coupled to or modified by a MM, such coupling or modification can effect a structural change that reduces or inhibits the ability of the AB to specifically bind its target.

In an activatable antibody, when the AB is coupled to or modified with an MM, at least a portion of the activatable antibody can be represented by the following formulae (in order from an amino (N) terminal region to carboxyl (C) terminal region:

(MM)-(AB)

(AB)-(MM)

(MM)-L-(AB)

(AB)-L-(MM)

where MM is a masking moiety, the AB is an antibody or antibody fragment thereof, and the L is a linker. In many embodiments, it may be desirable to insert one or more linkers, e.g., flexible linkers, into the composition so as to provide for flexibility.

In a multispecific activatable antibody, when at least one AB is coupled to or modified with an MM, at least a portion of the multispecific activatable antibody can be represented by the following formulae (in order from an amino (N) terminal region to carboxyl (C) terminal region:

(MM)-(AB)

(AB)-(MM)

(MM)-L-(AB)

(AB)-L-(MM)

where MM is a masking moiety, the AB is an antibody or antibody fragment thereof, and the L is a linker. In many embodiments, it may be desirable to insert one or more linkers, e.g., flexible linkers, into the composition so as to provide for flexibility.

In certain embodiments, the MM is not a natural binding partner of the AB. In some embodiments, the MM contains no or substantially no homology to any natural binding partner of the AB. In other embodiments the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 25% identical to any natural binding partner of the AB. In some embodiments, the MM is no more than 50% identical to any natural binding partner of the AB. In some embodiments, the MM is no more than 20% identical to any natural binding partner of the AB. In some embodiments, the MM is no more than 10% identical to any natural binding partner of the AB.

In some embodiments, the activatable antibodies and/or the multispecific activatable antibodies include an AB that is modified by an MM and also includes one or more cleavable moieties (CM). Such activatable antibodies and/or multispecific activatable antibodies exhibit activatable/switchable binding, to the AB's target. Activatable antibodies and/or multispecific activatable antibodies generally include at least one antibody or antibody fragment (AB), modified by or coupled to a masking moiety (MM) and a modifiable or cleavable moiety (CM). In some embodiments, the CM contains an amino acid sequence that serves as a substrate for a protease of interest.

The elements of the activatable antibodies and/or multispecific activatable antibodies are arranged so that each MM and CM are positioned such that in a cleaved (or relatively active) state and in the presence of a target, the corresponding AB binds a target, while in an uncleaved (or relatively inactive) state in the presence of the target, specific binding of the AB to its target, is reduced or inhibited. The specific binding of the AB to its target can be reduced due to the inhibition or masking of the AB's ability to specifically bind its target by the MM.

The $K_d$ of each AB modified with a MM and a CM towards the target, is at least 5, 10, 20, 25, 40, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM and a CM or of the parental AB towards the target. Conversely, the binding affinity of each AB modified with a MM and a CM towards the target, is at least 5, 10, 20, 25, 40, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM and a CM or of the parental AB towards the target.

When at least one AB is modified with a MM and a CM and is in the presence of the target but not in the presence of a modifying agent (for example a protease), specific binding of that AB to its target, is reduced or inhibited, as compared to the specific binding of the AB not modified with an MM and a CM or of the parental AB to the target. When compared to the binding of the parental AB or the binding of an AB not modified with an MM and a CM to its target, the AB's ability to bind the target when modified with an MM and a CM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

As used herein, the term cleaved state refers to the condition of the activatable antibodies and/or multispecific activatable antibodies following modification of the CM by a protease. The term uncleaved state, as used herein, refers to the condition of the activatable antibodies and/or multispecific activatable antibodies in the absence of cleavage of the CM by a protease. As discussed above, the term "activatable antibodies" is used herein to refer to an activatable antibody in both its uncleaved (native) state, as well as in its cleaved state. It will be apparent to the ordinarily skilled artisan that in some embodiments, a cleaved activatable antibody may lack an MM due to cleavage of the CM by protease, resulting in release of at least the MM (e.g., where the MM is not joined to the activatable antibodies by a covalent bond (e.g., a disulfide bond between cysteine residues). As discussed above, the term "multispecific activatable antibodies" is used herein to refer to a multispecific activatable antibody in both its uncleaved (native) state, as well as in its cleaved state. It will be apparent to the ordinarily skilled artisan that in some embodiments, a cleaved multispecific activatable antibody may lack an MM due to cleavage of the CM by protease, resulting in release of at least the MM (e.g., where the MM is not joined to the multispecific activatable antibodies by a covalent bond (e.g., a disulfide bond between cysteine residues).

By activatable or switchable is meant that the activatable antibody and/or multispecific activatable antibody exhibits a first level of binding to a target when the activatable antibody is in a inhibited, masked or uncleaved state (i.e., a first conformation), and a second level of binding to the target, when the activatable antibody is in the uninhibited, unmasked and/or cleaved state (i.e., a second conformation), where the second level of target binding is greater than the first level of binding. In general, the access of target to the corresponding AB of the activatable antibody and/or multispecific activatable antibody is greater in the presence of a cleaving agent capable of cleaving the CM than in the absence of such a cleaving agent. Thus, when the activatable antibody and/or multispecific activatable antibody is in the uncleaved state, at least one AB is inhibited from target binding and can be masked from target binding (i.e., the first conformation is such the AB cannot bind the target), and when the activatable antibody is in the cleaved state the AB is not inhibited or is unmasked to target binding.

The CM and AB of the activatable antibodies are selected so that the first AB represents a binding moiety for CD3ε, and the CM represents a substrate for a protease that is produced by a tumor that is in proximity to cells that express CD3ε and/or produced by a tumor that is co-localized with CD3ε at a treatment site or diagnostic site in a subject. The activatable antibodies disclosed herein find particular use where, for example, a protease capable of cleaving a site in the CM is present at relatively higher levels in CD3ε-containing tissue of a treatment site or diagnostic site than in tissue of non-treatment sites (for example in healthy tissue).

The CM and AB of the activatable antibodies and/or multispecific activatable antibodies are selected so that the first AB represents a binding moiety for a first target and/or epitope, and the CM represents a substrate for a protease that is produced by a tumor that is in proximity to cells that express the target and/or produced by a tumor that is co-localized with the target at a treatment site or diagnostic site in a subject. The activatable antibodies and/or multispecific activatable antibodies disclosed herein find particular use where, for example, a protease capable of cleaving a site in the CM is present at relatively higher levels in target-containing tissue of a treatment site or diagnostic site than in tissue of non-treatment sites (for example in healthy tissue).

In some embodiments, activatable antibodies provide for reduced toxicity and/or adverse side effects that could otherwise result from binding of the AB at non-treatment sites if the AB were not masked or otherwise inhibited from binding CD3ε.

In general, an activatable antibody can be designed by selecting at first AB of interest and constructing the remainder of the activatable antibody so that, when conformationally constrained, the MM provides for masking of the AB or reduction of binding of the AB to CD3ε. Structural design criteria can be to be taken into account to provide for this functional feature.

In some embodiments, multispecific activatable antibodies provide for reduced toxicity and/or adverse side effects that could otherwise result from binding of the first AB at non-treatment sites if the AB were not masked or otherwise inhibited from binding its target.

In general, a multispecific activatable antibody can be designed by selecting at first AB of interest and constructing the remainder of the activatable antibody so that, when conformationally constrained, the MM provides for masking of the AB or reduction of binding of the AB to its target. Structural design criteria can be to be taken into account to provide for this functional feature.

Activatable antibodies and/or multispecific activatable antibodies exhibiting a switchable phenotype of a desired dynamic range for target binding in an inhibited versus an uninhibited conformation are provided. Dynamic range generally refers to a ratio of (a) a maximum detected level of a parameter under a first set of conditions to (b) a minimum detected value of that parameter under a second set of conditions. For example, in the context of an activatable antibody and/or a multispecific activatable antibody, the dynamic range refers to the ratio of (a) a maximum detected level of target protein, binding to an activatable antibody and/or a multispecific activatable antibody in the presence of protease capable of cleaving the CM of the activatable antibodies to (b) a minimum detected level of target protein, binding to an activatable antibody and/or a multispecific activatable antibody in the absence of the protease. The dynamic range of an activatable antibody and/or a multispecific activatable antibody can be calculated as the ratio of the dissociation constant of an activatable antibody and/or a multispecific activatable antibody cleaving agent (e.g., enzyme) treatment to the dissociation constant of the activatable antibodies cleaving agent treatment. The greater the dynamic range of an activatable antibody and/or multispecific activatable antibody, the better the switchable phenotype of the activatable antibody. Activatable antibodies having relatively higher dynamic range values (e.g., greater than 1) exhibit more desirable switching phenotypes such that target protein binding by the activatable antibodies occurs to a greater extent (e.g., predominantly occurs) in the presence of a cleaving agent (e.g., enzyme) capable of cleaving the CM of the activatable antibodies than in the absence of a cleaving agent.

Activatable antibodies and/or multispecific activatable antibodies can be provided in a variety of structural configurations. Exemplary formulae for at least a portion of an activatable antibody and/or a multispecific activatable antibody are provided below. It is specifically contemplated that the N- to C-terminal order of the AB, the corresponding MM and CM may be reversed within an activatable antibody. It is also specifically contemplated that the CM and MM may overlap in amino acid sequence, e.g., such that the CM is contained within the MM.

For example, at least a portion of the activatable antibody activatable antibodies can be represented by the following formula (in order from an amino (N) terminal region to carboxyl (C) terminal region:

(MM)-(CM)-(AB)

(AB)-(CM)-(MM)

where MM is a masking moiety, CM is a cleavable moiety, and AB is an antibody or fragment thereof. It should be noted that although MM and CM are indicated as distinct components in the formulae above, in all exemplary embodiments (including formulae) disclosed herein it is contemplated that the amino acid sequences of the MM and the CM could overlap, e.g., such that the CM is completely or partially contained within the MM. In addition, the formulae above provide for additional amino acid sequences that may be positioned N-terminal or C-terminal to the activatable antibodies elements.

For example, at least a portion of the multispecific activatable antibodies can be represented by the following formula (in order from an amino (N) terminal region to carboxyl (C) terminal region:

(MM)-(CM)-(AB)

(AB)-(CM)-(MM)

where MM is a masking moiety, CM is a cleavable moiety, and AB is a first antibody or fragment thereof. It should be noted that although MM and CM are indicated as distinct components in the formulae above, in all exemplary embodiments (including formulae) disclosed herein it is contemplated that the amino acid sequences of the MM and the CM could overlap, e.g., such that the CM is completely or partially contained within the MM. In addition, the formulae above provide for additional amino acid sequences that may be positioned N-terminal or C-terminal to the activatable antibodies elements.

In certain embodiments, the MM is not a natural binding partner of the AB. In some embodiments, the MM contains no or substantially no homology to any natural binding partner of the AB. In other embodiments the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 50% identical to any natural binding partner of the AB. In some embodiments, the MM is no more than 25% identical to any natural binding partner of the AB. In some embodiments, the MM is no more than 20% identical to any natural binding partner of the AB. In some embodiments, the MM is no more than 10% identical to any natural binding partner of the AB.

In many embodiments it may be desirable to insert one or more linkers, e.g., flexible linkers, into the activatable antibody and/or the multispecific activatable antibody construct so as to provide for flexibility at one or more of the MM-CM junction, the CM-AB junction, or both. For example, the AB, MM, and/or CM may not contain a sufficient number of residues (e.g., Gly, Ser, Asp, Asn, especially Gly and Ser, particularly Gly) to provide the desired flexibility. As such, the switchable phenotype of such activatable antibody and/ or multispecific activatable antibody constructs may benefit from introduction of one or more amino acids to provide for a flexible linker. In addition, as described below, where the activatable antibody and/or the multispecific activatable antibody is provided as a conformationally constrained construct, a flexible linker can be operably inserted to facilitate formation and maintenance of a cyclic structure in the uncleaved activatable antibody and/or the uncleaved multispecific activatable antibody.

For example, in certain embodiments an activatable antibody and/or a multispecific activatable antibody comprises one of the following formulae (where the formula below represent an amino acid sequence in either N- to C-terminal direction or C- to N-terminal direction):

(MM)-L1-(CM)-(AB)

(MM)-(CM)-L2-(AB)

(MM)-L1-(CM)-L2-(AB)

wherein MM, CM, and AB are as defined above; wherein L1 and L2 are each independently and optionally present or absent, are the same or different flexible linkers that include at least 1 flexible amino acid (e.g., Gly). In addition, the formulae above provide for additional amino acid sequences that may be positioned N-terminal or C-terminal to the activatable antibody and/or the multispecific activatable antibodies elements. Examples include, but are not limited to, targeting moieties (e.g., a ligand for a receptor of a cell present in a target tissue) and serum half-life extending moieties (e.g., polypeptides that bind serum proteins, such as immunoglobulin (e.g., IgG) or serum albumin (e.g., human serum albumin (HAS)).

In some non-limiting embodiments, at least one of the AB in the multispecific activatable antibody is a binding partner for any target listed in Table 1.

In some non-limiting embodiments, at least one of the AB in the multispecific activatable antibody comprises, is or is derived from a sequence set forth in the Examples provided herein.

In some non-limiting embodiments, at least one of the AB in the multispecific activatable antibody comprises, is or is derived from a sequence set forth in Example 2 and/or Example 4 in the Examples provided herein.

In some non-limiting embodiments, at least one of the AB in the multispecific activatable antibody is or is derived from an antibody listed in Table 2.

In some embodiments, the masking moiety is selected for use with a specific antibody or antibody fragment. For example, suitable masking moieties for use with antibodies that bind EGFR include MMs that include the sequence CISPRG (SEQ ID NO: 164). By way of non-limiting examples, the MM can include a sequence such as CISPRGC (SEQ ID NO: 165); CISPRGCG (SEQ ID NO: 166); CISPRGCPDGPYVMY (SEQ ID NO: 167); CISPRGCPDGPYVM (SEQ ID NO: 168), CISPRGCEPGTYVPT (SEQ ID NO: 169) and CISPRGCPGQIWHPP (SEQ ID NO: 170). Other suitable masking moieties include any of the EGFR-specific masks disclosed in PCT Publication No. WO 2010/081173, such as, by way of non-limiting example, GSHCLIPINMGAPSC (SEQ ID NO: 171); CISPRGCGGSSASQSGQGSHCLIPINMGAPSC (SEQ ID NO: 172); CNHHYFYTCGCISPRGCPG (SEQ ID NO: 173); ADHVFWGSYGCISPRGCPG (SEQ ID NO: 174); CHHVYWGHCGCISPRGCPG (SEQ ID NO: 175); CPHFTTTSCGCISPRGCPG (SEQ ID NO: 176); CNHHYHYYCGCISPRGCPG (SEQ ID NO: 177); CPHVSFGSCGCISPRGCPG (SEQ ID NO: 178); CPYYTLSYCGCISPRGCPG (SEQ ID NO: 179); CNHVYFGTCGCISPRGCPG (SEQ ID NO: 180); CNHFTLTTCGCISPRGCPG (SEQ ID NO: 181); CHHFTLTTCGCISPRGCPG (SEQ ID NO: 182); YNPCATPMCCISPRGCPG (SEQ ID NO: 183); CNHHYFYTCGCISPRGCG (SEQ ID NO: 184); CNHHYHYYCGCISPRGCG (SEQ ID NO: 185); CNHVYFGTCGCISPRGCG (SEQ ID NO: 186); CHHVYWGHCGCISPRGCG (SEQ ID NO: 187); CPHFTTTSCGCISPRGCG (SEQ ID NO: 188); CNHFTLTTCGCISPRGCG (SEQ ID NO: 189); CHHFTLTTCGCISPRGCG (SEQ ID NO: 190); CPYYTLSYCGCISPRGCG (SEQ ID NO: 191); CPHVSFGSCGCISPRGCG (SEQ ID NO: 192); ADHVFWGSYGCISPRGCG (SEQ ID NO: 193); YNPCATPMCCISPRGCG (SEQ ID NO: 194); CHHVYWGHCGCISPRGCG (SEQ ID NO: 195); C(N/P)H(H/V/F)(Y/T)(F/W/T/L)(Y/G/T/S)(T/S/Y/H)CGCISPRGCG (SEQ ID NO: 196); CISPRGCGQPIPSVK (SEQ ID NO: 197); CISPRGCTQPYHVSR (SEQ ID NO: 198); and/or CISPRGCNAVSGLGS (SEQ ID NO: 199).

Suitable masking moieties for use with antibodies that bind a Jagged target, e.g., Jagged 1 and/or Jagged 2, include, by way of non-limiting example, masking moieties that include a sequence such as QGQSGQCNIWLVGGDCRGWQG (SEQ ID NO: 200); QGQSGQGQQQWCNIWINGGDCRGWNG (SEQ ID NO: 201); PWCMQRQDFLRCPQP (SEQ ID NO: 202); QLGLPAYMCTFECLR (SEQ ID NO: 203); CNLWVSGGDCGGLQG (SEQ ID NO: 204); SCSLWTSGSCLPHSP (SEQ ID NO: 205); YCLQLPHYMQAMCGR (SEQ ID NO: 206); CFLYSCTDVSYWNNT (SEQ ID NO: 207); PWCMQRQDYLRCPQP (SEQ ID NO: 208); CNLWISGGDCRGLAG (SEQ ID NO: 209); CNLWVSGGDCRGVQG (SEQ ID NO: 210); CNLWVSGGDCRGLRG (SEQ ID NO: 211); CNLWISGGDCRGLPG (SEQ ID NO: 212); CNLWVSGGDCRDAPW (SEQ ID NO: 213); CNLWVSGGDCRDLLG (SEQ ID NO: 214); CNLWVSGGDCRGLQG (SEQ ID NO: 215); CNLWLHGGDCRGWQG (SEQ ID NO: 216); CNIWLVGGDCRGWQG (SEQ ID NO: 217); CTTWFCGGDCGVMRG (SEQ ID NO: 218); CNIWGPSVDCGALLG (SEQ ID NO: 219); CNIWVNGGDCRSFEG (SEQ ID NO: 220); YCLNLPRYMQDMCWA (SEQ ID NO: 221); YCLALPHYMQADCAR (SEQ ID NO: 222); CFLYSCGDVSYWGSA (SEQ ID NO: 223); CYLYSCTDSAFWNNR (SEQ ID NO: 224); CYLYSCNDVSYWSNT (SEQ ID NO: 225); CFLYSCTDVSYW (SEQ ID NO: 226); CFLYSCTDVAYWNSA (SEQ ID NO: 227); CFLYSCTDVSYWGDT (SEQ ID NO: 228); CFLYSCTDVSYWGNS (SEQ ID NO: 229); CFLYSCTDVAYWNNT (SEQ ID NO: 230); CFLYSCGDVSYWGNPGLS (SEQ ID NO: 231); CFLYSCTDVAYWSGL (SEQ ID NO: 232); CYLYSCTDGSYWNST (SEQ ID NO: 233); CFLYSCSDVSYWGNI (SEQ ID NO: 234); CFLYSCTDVAYW (SEQ ID NO: 235); CFLYSCTDVSYWGST (SEQ ID NO: 236); CFLYSCTDVAYWGDT (SEQ ID NO: 237); GCNIWLNGGDCRGWVDPLQG (SEQ ID NO: 238); GCNIWLVGGDCRGWIGDTNG (SEQ ID NO: 239); GCNIWLVGGDCRGWIEDSNG (SEQ ID NO: 240); GCNIWANGGDCRGWIDNIDG (SEQ ID NO: 241); GCNIWLVGGDCRGWLGEAVG (SEQ ID NO: 242); GCNIWLVGGDCRGWLEEAVG (SEQ ID NO: 243); GGPALCNIWLNGGDCRGWSG (SEQ ID NO: 244); GAPVFCNIWLNGGDCRGWMG (SEQ ID NO: 245); GQQQWCNIWINGGDCRGWNG (SEQ ID NO: 246); GKSEFCNIWLNGGDCRGWIG (SEQ ID NO: 247); GTPGGCNIWANGGDCRGWEG (SEQ ID NO: 248); GASQYCNLWINGGDCRGWRG (SEQ ID NO: 249); GCNIWLVGGDCRPWVEGG (SEQ ID NO: 250); GCNIWAVGGDCRPFVDGG (SEQ ID NO: 251); GCNIWLNG- GDCRAWVDTG (SEQ ID NO: 252); GCNIWIVGGDCR-PFINDG (SEQ ID NO: 253); GCNIWLNGGDCRPVVFGG (SEQ ID NO: 254); GCNIWLSGGDCRMFMNEG (SEQ ID NO: 255); GCNIWVNGGDCRSFVYSG (SEQ ID NO: 256); GCNIWLNGGDCRGWEASG (SEQ ID NO: 257); GCNIWAHGGDCRGFIEPG (SEQ ID NO: 258); GCNIWLNGGDCRTFVASG (SEQ ID NO: 259); GCNIWAHGGDCRGFIEPG (SEQ ID NO: 260); GFLENCNIWLNGGDCRTG (SEQ ID NO: 261); GIYENCNIWLNGGDCRMG (SEQ ID NO: 262); and/or GIPDNCNIWINGGDCRYG (SEQ ID NO: 263).

Suitable masking moieties for use with antibodies that bind an interleukin 6 target, e.g., interleukin 6 receptor (IL-6R), include, by way of non-limiting example, masking moieties that include a sequence such as QGQSGQYGSC-SWNYVHIFMDC (SEQ ID NO: 264); QGQSGQGDFDIP-FPAHWVPIT (SEQ ID NO: 265); QGQSGQMGV-PAGCVWNYAHIFMDC (SEQ ID NO: 266); YRSCNWNYVSIFLDC (SEQ ID NO: 267); PGAFDIP-FPAHWVPNT (SEQ ID NO: 268); ESSCVWNYVHI-YMDC (SEQ ID NO: 269); YPGCKWNYDRIFLDC (SEQ ID NO: 270); YRTCSWNYVGIFLDC (SEQ ID NO: 271); YGSCSWNYVHIFMDC (SEQ ID NO: 272); YGSC-SWNYVHIFLDC (SEQ ID NO: 273); YGSCNWNYVHI-FLDC (SEQ ID NO: 274); YTSCNWNYVHIFMDC (SEQ ID NO: 275); YPGCKWNYDRIFLDC (SEQ ID NO: 276); WRSCNWNYAHIFLDC (SEQ ID NO: 277); WSNCH-WNYVHIFLDC (SEQ ID NO: 278); DRSCTWNYVRI-SYDC (SEQ ID NO: 279); SGSCKWDYVHIFLDC (SEQ ID NO: 280); SRSCIWNYAHIHLDC (SEQ ID NO: 281); SMSCYWQYERIFLDC (SEQ ID NO: 282); YRSCN-WNYVSIFLDC (SEQ ID NO: 283); YGSCSWNYVHIF-MDC (SEQ ID NO: 284); SGSCKWDYVHIFLDC (SEQ ID NO: 285); YKSCHWDYVHIFLDC (SEQ ID NO: 286); YGSCTWNYVHIFMEC (SEQ ID NO: 287); FSSCN-WNYVHIFLDC (SEQ ID NO: 288); WRSCNWNYAHI-FLDC (SEQ ID NO: 289); YGSCQWNYVHIFLDC (SEQ ID NO: 290); YRSCNWNYVHIFLDC (SEQ ID NO: 291); NMSCHWDYVHIFLDC (SEQ ID NO: 292); FGPCTWN-YARISWDC (SEQ ID NO: 293); XXsCXWXYvhIfXdC (SEQ ID NO: 294); MGVPAGCVWNYAHIFMDC (SEQ ID NO: 295); RDTGGQCRWDYVHIFMDC (SEQ ID NO: 296); AGVPAGCTWNYVHIFMEC (SEQ ID NO: 297); VGVPNGCVWNYAHIFMEC (SEQ ID NO: 298); DGG-PAGCSWNYVHIFMEC (SEQ ID NO: 299); AVGPAGCW-WNYVHIFMEC (SEQ ID NO: 300); CTWNYVHIFMD-CGEGEGP (SEQ ID NO: 301); GGVPEGCTWNYAHIFMEC (SEQ ID NO: 302); AEV-PAGCWWNYVHIFMEC (SEQ ID NO: 303); AGV-PAGCTWNYVHIFMEC (SEQ ID NO: 304); SGASGGCK-WNYVHIFMDC (SEQ ID NO: 305); MGVPAGCVWNYAHIFMDC (SEQ ID NO: 306); TPGCRWNYVHIFMECEAL (SEQ ID NO: 307); VGVPNGCVWNYAHIFMEC (SEQ ID NO: 308); PGAF-DIPFPAHWVPNT (SEQ ID NO: 309); RGACDIPFPAH-WIPNT (SEQ ID NO: 310); QGDFDIPFPAHWVPIT (SEQ ID NO: 311); XGafDIPFPAHWvPnT (SEQ ID NO: 312); RGDGNDSDIPFPAHWVPRT (SEQ ID NO: 313); SGVGRDRDIPFPAHWVPRT (SEQ ID NO: 314); WAG-GNDCDIPFPAHWIPNT (SEQ ID NO: 315); WGDGMD-VDIPFPAHWVPVT (SEQ ID NO: 316); AGSGNDSDIP-FPAHWVPRT (SEQ ID NO: 317); ESRSGYADIPFPAHWVPRT (SEQ ID NO: 318); and/or RECGRCGDIPFPAHWVPRT (SEQ ID NO: 319).

In some embodiments, the cleavable moiety (CM) of the activatable antibody and/or the multispecific activatable antibody includes an amino acid sequence that can serve as a substrate for a protease, usually an extracellular protease. The CM may be selected based on a protease that is produced by a tumor that is in proximity to cells that express the target and/or produced by a tumor that is co-localized in tissue with the desired target of at least one AB of the multispecific activatable antibody. A variety of different conditions are known in which a target of interest is produced by a tumor that is in proximity to cells that express the target and/or produced by a tumor that is co-localized with a protease, where the substrate of the protease is known in the art. In the example of cancer, the target tissue can be a cancerous tissue, particularly cancerous tissue of a solid tumor. There are reports in the literature of increased levels of proteases having known substrates in a number of cancers, e.g., solid tumors. See, e.g., La Rocca et al, (2004) British J. of Cancer 90(7): 1414-1421. Non-liming examples of disease include: all types of cancers (breast, lung, colorectal, prostate, melanomas, head and neck, pancreatic, etc.), rheumatoid arthritis, Crohn's disuse, SLE, cardiovascular damage, ischemia, etc. For example, indications would include leukemias, including T-cell acute lymphoblastic leukemia (T-ALL), lymphoblastic diseases including multiple myeloma, and solid tumors, including lung, colorectal, prostate, pancreatic and breast, including triple negative breast cancer. For example, indications include bone disease or metastasis in cancer, regardless of primary tumor origin; breast cancer, including by way of non-limiting example, ER/PR+ breast cancer, Her2+ breast cancer, triple-negative breast cancer; colorectal cancer; endometrial cancer; gastric cancer; glioblastoma; head and neck cancer, such as esophageal cancer; lung cancer, such as by way of non-limiting example, non-small cell lung cancer; multiple myeloma ovarian cancer; pancreatic cancer; prostate cancer; sarcoma, such as osteosarcoma; renal cancer, such as by way of nonlimiting example, renal cell carcinoma; and/or skin cancer, such as by way of nonlimiting example, squamous cell cancer, basal cell carcinoma, or melanoma. In some embodiments, the cancer is a squamous cell cancer. In some embodiments, the cancer is a skin squamous cell carcinoma. In some embodiments, the cancer is an esophageal squamous cell carcinoma. In some embodiments, the cancer is a head and neck squamous cell carcinoma. In some embodiments, the cancer is a lung squamous cell carcinoma.

The CM is specifically cleaved by an enzyme at a rate of about 0.001-1500×$10^4$ $M^{-1}S^{-1}$ or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or 1500×$10^4$ $M^{-1}S^{-1}$.

For specific cleavage by an enzyme, contact between the enzyme and CM is made. When the activatable antibody comprising an AB coupled to a MM and a CM is in the presence of target and sufficient enzyme activity, the CM can be cleaved. When the multispecific activatable antibody comprising at least a first AB coupled to a MM and a CM is in the presence of target and sufficient enzyme activity, the CM can be cleaved. Sufficient enzyme activity can refer to the ability of the enzyme to make contact with the CM and effect cleavage. It can readily be envisioned that an enzyme may be in the vicinity of the CM but unable to cleave because of other cellular factors or protein modification of the enzyme.

Exemplary substrates include but are not limited to substrates cleavable by one or more of the following enzymes or proteases in Table 3:

TABLE 3

| Exemplary Proteases and/or Enzymes |
|---|
| ADAMS, ADAMTS, e.g., |
| ADAM8 |
| ADAM9 |
| ADAM10 |
| ADAM12 |
| ADAM15 |
| ADAM17/TACE |
| ADAMDEC1 |
| ADAMTS1 |
| ADAMTS4 |
| ADAMTS5 |
| Aspartate proteases, e.g., |
| BACE |
| Renin |
| Aspartic cathepsins, e.g., |
| Cathepsin D |
| Cathepsin E |
| Caspases, e.g., |
| Caspase 1 |
| Caspase 2 |
| Caspase 3 |
| Caspase 4 |
| Caspase 5 |
| Caspase 6 |
| Caspase 7 |
| Caspase 8 |
| Caspase 9 |
| Caspase 10 |
| Caspase 14 |
| Cysteine cathepsins, e.g., |
| Cathepsin B |
| Cathepsin C |
| Cathepsin K |
| Cathepsin L |
| Cathepsin S |
| Cathepsin V/L2 |
| Cathepsin X/Z/P |
| Cysteine proteinases, e.g., |
| Cruzipain |
| Legumain |
| Otubain-2 |
| KLKs, e.g., |
| KLK4 |
| KLK5 |
| KLK6 |
| KLK7 |
| KLK8 |
| KLK10 |
| KLK11 |
| KLK13 |
| KLK14 |
| Metallo proteinases, e.g., |
| Meprin |
| Neprilysin |
| PSMA |
| BMP-1 |
| MMPs, e.g., |
| MMP1 |
| MMP2 |
| MMP3 |
| MMP7 |
| MMP8 |
| MMP9 |
| MMP10 |
| MMP11 |
| MMP12 |
| MMP13 |
| MMP14 |
| MMP15 |
| MMP16 |
| MMP17 |
| MMP19 |
| MMP20 |
| MMP23 |
| MMP24 |
| MMP26 |
| MMP27 |

TABLE 3-continued

| Exemplary Proteases and/or Enzymes |
|---|
| Serine proteases, e.g., |
| activated protein C |
| Cathepsin A |
| Cathepsin G |
| Chymase |
| coagulation factor proteases |
| (e.g., FVIIa, FIXa, FXa, FXIa, |
| FXIIa) |
| Elastase |
| Granzyme B |
| Guanidinobenzoatase |
| HtrA1 |
| Human Neutrophil Elastase |
| Lactoferrin |
| Marapsin |
| NS3/4A |
| PACE4 |
| Plasmin |
| PSA |
| tPA |
| Thrombin |
| Tryptase |
| uPA |
| Type II Transmembrane |
| Serine Proteases (TTSPs), e.g., |
| DESC1 |
| DPP-4 |
| FAP |
| Hepsin |
| Matriptase-2 |
| Matriptase |
| TMPRSS2 |
| TMRSS3 |
| TMPRSS4 |

For example, in some embodiments, the substrate is cleavable by one or more of the following enzymes or proteases: uPA, legumain, matriptase, ADAM17, BMP-1, TMPRSS3, TMPRSS4, MMP-9, MMP-12, MMP-13, and/or MMP-14. In some embodiments, the protease is selected from the group of uPA, legumain, and matriptase. In some embodiments, the protease is a matrix metalloproteinase. In some embodiments, the protease comprises uPA. In some embodiments, the protease comprises legumain. In some embodiments, the protease comprises matriptase.

In some embodiments, the CM is selected for use with a specific protease. In some embodiments, the CM is a substrate for at least one protease selected from the group consisting of an ADAM 17, a BMP-1, a cysteine protease such as a cathepsin, a HtrA1, a legumain, a matriptase (MT-SP1), a matrix metalloprotease (MMP), a neutrophil elastase, a TMPRSS, such as TMPRSS3 or TMPRSS4, a thrombin, and a u-type plasminogen activator (uPA, also referred to as urokinase).

In some embodiments, the CM is a substrate for an ADAM17. In some embodiments, the CM is a substrate for a BMP-1. In some embodiments, the CM is a substrate for a cathepsin. In some embodiments, the CM is a substrate for a cysteine protease. In some embodiments, the CM is a substrate for a HtrA1. In some embodiments, the CM is a substrate for a legumain. In some embodiments, the CM is a substrate for matriptase. In some embodiments, the CM is a substrate for a MMP. In some embodiments, the CM is a substrate for a neutrophil elastase. In some embodiments, the CM is a substrate for a thrombin. In some embodiments, the CM is a substrate for a TMPRSS. In some embodiments, the CM is a substrate for TMPRSS3. In some embodiments, the CM is a substrate for TMPRSS4. In some embodiments, the CM is a substrate for uPA.

In some embodiments, the cleavable moiety is selected for use with a specific protease, for example a protease that is known to be produced by a tumor that is in proximity to cells that express the target and/or produced by a tumor that is co-localized with the target of the activatable antibody. For example, suitable cleavable moieties for use in the activatable antibodies of the disclosure include the sequence TGRGPSWV (SEQ ID NO: 68); SARGPSRW (SEQ ID NO: 69); TARGPSFK (SEQ ID NO: 70); LSGRSDNH (SEQ ID NO: 67); GGWHTGRN (SEQ ID NO: 71); HTGRSGAL (SEQ ID NO: 72); PLTGRSGG (SEQ ID NO: 73); AARGPAIH (SEQ ID NO: 74); RGPAFNPM (SEQ ID NO: 75); SSRGPAYL (SEQ ID NO: 76); RGPATPIM (SEQ ID NO: 77); RGPA (SEQ ID NO: 78); GGQPSGMWGW (SEQ ID NO: 79); FPRPLGITGL (SEQ ID NO: 80); VHMPLGFLGP (SEQ ID NO: 81); SPLTGRSG (SEQ ID NO: 82); SAGFSLPA (SEQ ID NO: 83); LAPLGLQRR (SEQ ID NO: 84); SGGPLGVR (SEQ ID NO: 85); and/or PLGL (SEQ ID NO: 86).

In some embodiments, the CM is a substrate for at least one matrix metalloprotease (MMP). Examples of MMPs include MMP1; MMP2; MMP3; MMP7; MMP8; MMP9; MMP10; MMP11; MMP12; MMP13; MMP14; MMP15; MMP16; MMP17; MMP19; MMP20; MMP23; MMP24; MMP26; and MMP27. In some embodiments, the CM is a substrate for MMP9, MMP14, MMP1, MMP3, MMP13, MMP17, MMP11, and MMP19. In some embodiments, the CM is a substrate for MMP7. In some embodiments, the CM is a substrate for MMP9. In some embodiments, the CM is a substrate for MMP14. In some embodiments, the CM is a substrate for two or more MMPs. In some embodiments, the CM is a substrate for at least MMP9 and MMP14. In some embodiments, the CM comprises two or more substrates for the same MMP. In some embodiments, the CM comprises at least two or more MMP9 substrates. In some embodiments, the CM comprises at least two or more MMP14 substrates.

In some embodiments, the CM is a substrate for an MMP and includes the sequence ISSGLLSS (SEQ ID NO: 321); QNQALRMA (SEQ ID NO: 322); AQNLLGMV (SEQ ID NO: 323); STFPFGMF (SEQ ID NO: 324); PVGYTSSL (SEQ ID NO: 325); DWLYWPGI (SEQ ID NO: 326); MIAPVAYR (SEQ ID NO: 327); RPSPMWAY (SEQ ID NO: 328); WATPRPMR (SEQ ID NO: 329); FRLLDWQW (SEQ ID NO: 330); LKAAPRWA (SEQ ID NO: 331); GPSHLVLT (SEQ ID NO: 332); LPGGLSPW (SEQ ID NO: 333); MGLFSEAG (SEQ ID NO: 334); SPLPLRVP (SEQ ID NO: 335); RMHLRSLG (SEQ ID NO: 336); LAAPLGLL (SEQ ID NO: 337); AVGLLAPP (SEQ ID NO: 338); LLAPSHRA (SEQ ID NO: 339); PAGLWLDP (SEQ ID NO: 340); and/or ISSGLSS (SEQ ID NO: 341).

In some embodiments, the CM is a substrate for thrombin. In some embodiments, the CM is a substrate for thrombin and includes the sequence GPRSFGL (SEQ ID NO: 896) or GPRSFG (SEQ ID NO: 897).

In some embodiments, the CM comprises an amino acid sequence selected from the group consisting of NTLSGRSENHSG (SEQ ID NO: 898); NTLSGRSGNHGS (SEQ ID NO: 899); TSTSGRSANPRG (SEQ ID NO: 900); TSGRSANP (SEQ ID NO: 901); VAGRSMRP (SEQ ID NO: 902); VVPEGRRS (SEQ ID NO: 903); ILPRSPAF (SEQ ID NO: 904); MVLGRSLL (SEQ ID NO: 905); QGRAITFI (SEQ ID NO: 906); SPRSIMLA (SEQ ID NO: 907); and SMLRSMPL (SEQ ID NO: 908).

In some embodiments, the CM is a substrate for a neutrophil elastase. In some embodiments, the CM is a substrate for a serine protease. In some embodiments, the CM is a substrate for uPA. In some embodiments, the CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, the CM is a CM1-CM2 substrate and includes the sequence ISSGLLSGRSDNH (SEQ ID NO: 909); ISSGLLSSGGSGGSLSGRSDNH (SEQ ID NO: 910); AVGLLAPPGGTSTSGRSANPRG (SEQ ID NO: 911); TSTSGRSANPRGGGAVGLLAPP (SEQ ID NO: 912); VHMPLGFLGPGGTSTSGRSANPRG (SEQ ID NO: 913); TSTSGRSANPRGGGVHMPLGFLGP (SEQ ID NO: 914); AVGLLAPPGGLSGRSDNH (SEQ ID NO: 915); LSGRSDNHGGAVGLLAPP (SEQ ID NO: 916); VHMPLGFLGPGGLSGRSDNH (SEQ ID NO: 917); LSGRSDNHGGVHMPLGFLGP (SEQ ID NO: 918); LSGRSDNHGGSGGSISSGLLSS (SEQ ID NO: 919); LSGRSGNHGGSGGSISSGLLSS (SEQ ID NO: 920); ISSGLLSSGGSGGSLSGRSGNH (SEQ ID NO: 921); LSGRSDNHGGSGGSQNQALRMA (SEQ ID NO: 922); QNQALRMAGGSGGSLSGRSDNH (SEQ ID NO: 923); LSGRSGNHGGSGGSQNQALRMA (SEQ ID NO: 924); QNQALRMAGGSGGSLSGRSGNH (SEQ ID NO: 925) and/or ISSGLLSGRSGNH (SEQ ID NO: 926).

In some embodiments, anti-CD3ε antibodies, activatable antibodies and/or multispecific antibodies and/or multispecific activatable antibodies of the disclosure may be made biosynthetically using recombinant DNA technology and expression in eukaryotic or prokaryotic species. For the activatable antibodies and/or multispecific activatable antibodies, the cDNAs encoding the masking moiety, linker sequence (that may include a cleavable moiety (CM), and antibody chain (heavy or light)) can be linked in an 5' to 3' (N- to C-terminal in the translated product) sequence to create the nucleic acid construct, which is expressed as the activatable antibody protein and/or multispecific activatable antibody protein following a conventional antibody expression process. In some embodiments, the activatable antibody and/or multispecific activatable antibody could be semi-synthetically produced by expressing a CM-antibody and then coupling the mask chemically at or near the N-terminus of the protein. In some embodiments, the activatable antibody and/or the multispecific activatable antibody could be produced by expressing an antibody and then coupling the mask and the CM chemically at or near the N-terminus of the protein such that the activatable antibody and/or at least a portion of the multispecific activatable antibody in the uncleaved state has the structural arrangement from N-terminus to C-terminus as follows: MM-CM-AB or AB-CM-MM.

Linkers suitable for use in compositions described herein are generally ones that provide flexibility of the modified AB or the multispecific activatable antibodies to facilitate the inhibition of the binding of at least the first AB to the target. Such linkers are generally referred to as flexible linkers. Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, 7, 8, 9, 10, 11, 12, 13, 14, 15, 16, 17, 18, 19, or 20 amino acids in length.

Exemplary flexible linkers include glycine polymers (G)n, glycine-serine polymers (including, for example, (GS)n, (GSGGS)n (SEQ ID NO: 59) and (GGGS)n (SEQ ID NO:

60), where n is an integer of at least one), glycine-alanine polymers, alanine-serine polymers, and other flexible linkers known in the art. Glycine and glycine-serine polymers are relatively unstructured, and therefore may be able to serve as a neutral tether between components. Glycine accesses significantly more phi-psi space than even alanine, and is much less restricted than residues with longer side chains (see Scheraga, Rev. Computational Chem. 11173-142 (1992)). Exemplary flexible linkers include, but are not limited to GGSG (SEQ ID NO: 61), GGSGG (SEQ ID NO: 62), GSGSG (SEQ ID NO: 63), GSGGG (SEQ ID NO: 64), GGGSG (SEQ ID NO: 65), GSSSG (SEQ ID NO: 66), and the like. The ordinarily skilled artisan will recognize that design of an activatable antibodies can include linkers that are all or partially flexible, such that the linker can include a flexible linker as well as one or more portions that confer less flexible structure to provide for a desired activatable antibodies and/or multispecific activatable antibodies structure.

In addition to the elements described above, the activatable antibodies and/or multispecific activatable antibodies can contain additional elements such as, for example, amino acid sequence N- or C-terminal of the activatable antibodies and/or multispecific activatable antibodies. For example, activatable antibodies and/or multispecific activatable antibodies can include a targeting moiety to facilitate delivery to a cell or tissue of interest. Activatable antibodies and/or multispecific activatable antibodies can be conjugated to an agent, such as a therapeutic agent, a detectable moiety or a diagnostic agent. Examples of agents are disclosed herein.

The activatable antibodies and/or multispecific activatable antibodies can also include any of the conjugated agents, linkers and other components described herein in conjunction with an activatable antibody and/or a multispecific antibody of the disclosure, including by way of non-limiting example, any of the agents listed in Table 4 and/or any of the linkers listed in Table 5 and/or Table 6.

Conjugated Antibodies, Conjugated Activatable Antibodies, Conjugated Multispecific Antibodies and Conjugated Multispecific Activatable Antibodies In some embodiments, the antibodies and/or activatable antibodies of the disclosure can be conjugated to an agent, such as for example, a therapeutic agent, a detectable moiety or a diagnostic agent. Suitable therapeutic agents include, by way of non-limiting example, a therapeutic agent for use in targeting a T cell-derived lymphoma. Suitable detectable agents include, by way of non-limiting example, a fluorescent dye, (e.g. a fluorophore, Fluorescein Isothiocyanate (FITC), Rhodamine Isothiocyanate (TRITC), an Alexa Fluor® label), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

The activatable anti-CD3ε antibodies have at least one point of conjugation for an agent, but in the methods and compositions provided herein less than all possible points of conjugation are available for conjugation to an agent. In some embodiments, the one or more points of conjugation are sulfur atoms involved in disulfide bonds. In some embodiments, the one or more points of conjugation are sulfur atoms involved in interchain disulfide bonds. In some embodiments, the one or more points of conjugation are sulfur atoms involved in interchain sulfide bonds, but not sulfur atoms involved in intrachain disulfide bonds. In some embodiments, the one or more points of conjugation are sulfur atoms of cysteine or other amino acid residues containing a sulfur atom. Such residues may occur naturally in the antibody structure or may be incorporated into the antibody by site-directed mutagenesis, chemical conversion, or mis-incorporation of non-natural amino acids.

Also provided are methods of preparing a conjugate of an activatable anti-CD3ε antibody having one or more interchain disulfide bonds in the AB and one or more intrachain disulfide bonds in the MM, and a drug reactive with free thiols is provided. The method generally includes partially reducing interchain disulfide bonds in the activatable antibody with a reducing agent, such as, for example, TCEP; and conjugating the drug reactive with free thiols to the partially reduced activatable antibody. As used herein, the term partial reduction refers to situations where an activatable anti-CD3ε antibody is contacted with a reducing agent and less than all disulfide bonds, e.g., less than all possible sites of conjugation are reduced. In some embodiments, less than 99%, 98%, 97%, 96%, 95%, 90%, 85%, 80%, 75%, 70%, 65%, 60%, 55%, 50%, 45%, 40%, 35%, 30%, 25%, 20%, 15%, 10% or less than 5% of all possible sites of conjugation are reduced.

In yet other embodiments, a method of reducing and conjugating an agent, e.g., a drug, to an activatable anti-CD3ε antibody resulting in selectivity in the placement of the agent is provided. The method generally includes partially reducing the activatable anti-CD3ε antibody with a reducing agent such that any conjugation sites in the masking moiety or other non-AB portion of the activatable antibody are not reduced, and conjugating the agent to interchain thiols in the AB. The conjugation site(s) are selected so as to allow desired placement of an agent to allow conjugation to occur at a desired site. The reducing agent is, for example, TCEP. The reduction reaction conditions such as, for example, the ratio of reducing agent to activatable antibody, the length of incubation, the temperature during the incubation, the pH of the reducing reaction solution, etc., are determined by identifying the conditions that produce a conjugated activatable antibody in which the MM retains the ability to effectively and efficiently mask the AB of the activatable antibody in an uncleaved state. The ratio of reduction agent to activatable anti-CD3ε antibody will vary depending on the activatable antibody. In some embodiments, the ratio of reducing agent to activatable anti-CD3ε antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

In some embodiments, a method of reducing interchain disulfide bonds in the AB of an activatable anti-CD3ε antibody and conjugating an agent, e.g., a thiol-containing agent such as a drug, to the resulting interchain thiols to selectively locate agent(s) on the AB is provided. The method generally includes partially reducing the AB with a reducing agent to form at least two interchain thiols without forming all possible interchain thiols in the activatable antibody; and conjugating the agent to the interchain thiols of the partially reduced AB. For example, the AB of the activatable antibody is partially reduced for about 1 hour at about 37° C. at a desired ratio of reducing agent:activatable antibody. In some embodiments, the ratio of reducing agent to activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

The thiol-containing reagent can be, for example, cysteine or N-acetyl cysteine. The reducing agent can be, for example, TCEP. In some embodiments, the reduced activatable antibody can be purified prior to conjugation, using for example, column chromatography, dialysis, or diafiltration. In some embodiments, the reduced antibody is not purified after partial reduction and prior to conjugation.

The disclosure also provides partially reduced activatable anti-CD3ε antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to a CD3ε target, a masking moiety (MM) that inhibits the binding of the AB of the activatable antibody in an uncleaved state to the CD3ε target, and a cleavable moiety (CM) coupled to the AB, wherein the CM is a polypeptide that functions as a substrate for a protease. In some embodiments the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: NEVI-CM-AB or AB-CM-MM. In some embodiments, reducing agent is TCEP.

The compositions and methods provided herein enable the attachment of one or more agents to one or more cysteine residues in any of the AB regions without compromising the activity (e.g., the masking, activating or binding activity) of the multispecific activatable antibody. In some embodiments, the compositions and methods provided herein enable the attachment of one or more agents to one or more cysteine residues in any of the AB regions without reducing or otherwise disturbing one or more disulfide bonds within any of the MM. The compositions and methods provided herein produce a multispecific activatable antibody that is conjugated to one or more agents, e.g., any of a variety of therapeutic, diagnostic and/or prophylactic agents, preferably without any of the agent(s) being conjugated to any of the MM of the multispecific activatable antibody. The compositions and methods provided herein produce conjugated multispecific activatable antibodies in which each of the MM retains the ability to effectively and efficiently mask its corresponding AB of the multispecific activatable antibody in an uncleaved state. The compositions and methods provided herein produce conjugated multispecific activatable antibodies in which the activatable antibody is still activated, i.e., cleaved, in the presence of a protease that can cleave the CM.

The multispecific activatable antibodies have at least one point of conjugation for an agent, but in the methods and compositions provided herein less than all possible points of conjugation are available for conjugation to an agent. In some embodiments, the one or more points of conjugation are sulfur atoms involved in disulfide bonds. In some embodiments, the one or more points of conjugation are sulfur atoms involved in interchain disulfide bonds. In some embodiments, the one or more points of conjugation are sulfur atoms involved in interchain sulfide bonds, but not sulfur atoms involved in intrachain disulfide bonds. In some embodiments, the one or more points of conjugation are sulfur atoms of cysteine or other amino acid residues containing a sulfur atom. Such residues may occur naturally in the antibody structure or may be incorporated into the antibody by site-directed mutagenesis, chemical conversion, or mis-incorporation of non-natural amino acids.

Also provided are methods of preparing a conjugate of a multispecific activatable antibody having one or more interchain disulfide bonds in one or more of the AB and one or more intrachain disulfide bonds in the corresponding MM, and a drug reactive with free thiols is provided. The method generally includes partially reducing interchain disulfide bonds in the activatable antibody with a reducing agent, such as, for example, TCEP; and conjugating the drug reactive with free thiols to the partially reduced activatable antibody. As used herein, the term partial reduction refers to situations where a multispecific activatable antibody is contacted with a reducing agent and less than all disulfide bonds, e.g., less than all possible sites of conjugation are reduced. In some embodiments, less than 99%, 98%, 97%, 96%, 95%, 90%, 85%, 80%, 75%, 70%, 65%, 60%, 55%, 50%, 45%, 40%, 35%, 30%, 25%, 20%, 15%, 10% or less than 5% of all possible sites of conjugation are reduced.

In yet other embodiments, a method of reducing and conjugating an agent, e.g., a drug, to a multispecific activatable antibody resulting in selectivity in the placement of the agent is provided. The method generally includes partially reducing the multispecific activatable antibody with a reducing agent such that any conjugation sites in any of the masking moieties or other non-AB portion of the activatable antibody are not reduced, and conjugating the agent to interchain thiols in one or more of the AB regions of the multispecific activatable antibody. The conjugation site(s) are selected so as to allow desired placement of an agent to allow conjugation to occur at a desired site. The reducing agent is, for example, TCEP. The reduction reaction conditions such as, for example, the ratio of reducing agent to activatable antibody, the length of incubation, the temperature during the incubation, the pH of the reducing reaction solution, etc., are determined by identifying the conditions that produce a conjugated activatable antibody in which the MM retains the ability to effectively and efficiently mask the AB of the activatable antibody in an uncleaved state. The ratio of reduction agent to multispecific activatable antibody will vary depending on the activatable antibody. In some embodiments, the ratio of reducing agent to multispecific activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

In some embodiments, a method of reducing interchain disulfide bonds in one or more of the AB regions of a multispecific activatable antibody and conjugating an agent, e.g., a thiol-containing agent such as a drug, to the resulting interchain thiols to selectively locate agent(s) on the AB is provided. The method generally includes partially reducing one or more of the AB regions with a reducing agent to form at least two interchain thiols without forming all possible interchain thiols in the activatable antibody; and conjugating the agent to the interchain thiols of the partially reduced AB. For example, one or more of the AB regions of the multispecific activatable antibody is partially reduced for about 1 hour at about 37° C. at a desired ratio of reducing agent: activatable antibody. In some embodiments, the ratio of reducing agent to activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

The thiol-containing reagent can be, for example, cysteine or N-acetyl cysteine. The reducing agent can be, for example, TCEP. In some embodiments, the reduced activatable antibody can be purified prior to conjugation, using for example, column chromatography, dialysis, or diafiltration. In some embodiments, the reduced antibody is not purified after partial reduction and prior to conjugation.

The disclosure also provides partially reduced multispecific activatable antibodies in which at least one interchain disulfide bond in the multispecific activatable antibody has been reduced with a reducing agent without disturbing any intrachain disulfide bonds in the multispecific activatable antibody, wherein the multispecific activatable antibody includes at least a first antibody or an antigen binding fragment thereof (AB1) that specifically binds to a target, a first masking moiety (MM1) that inhibits the binding of the AB1 of the multispecific activatable antibody in an uncleaved state to the target, a first cleavable moiety (CM1) coupled to the AB1, wherein the CM1 is a polypeptide that functions as a substrate for a protease, and a second antibody or an antigen binding fragment thereof (AB2) that specifically binds to a second target. In some embodiments, the MM1 is coupled to the AB1 via the CM1. In some embodiments, one or more intrachain disulfide bond(s) of the multispecific activatable antibody is not disturbed by the reducing agent. In some embodiments, one or more intrachain disulfide bond(s) of the MM1 within the multispecific activatable antibody is not disturbed by the reducing agent. In some embodiments, reducing agent is TCEP.

The disclosure also pertains to immunoconjugates comprising an anti-CD3ε antibody, an activatable antibody, a multispecific antibody and/or a multispecific activatable antibody conjugated to a cytotoxic agent such as a toxin (e.g., an enzymatically active toxin of bacterial, fungal, plant, or animal origin, or fragments thereof), or a radioactive isotope (i.e., a radioconjugate). Suitable cytotoxic agents for use in targeting diseased T cells such as in a T cell-derived lymphoma include, for example, dolastatins and derivatives thereof (e.g. auristatin E, AFP, MMAD, MMAF, MMAE). For example, the cytotoxic agent is monomethyl auristatin E (MMAE). In some embodiments, the agent is monomethyl auristatin E (MMAD). In some embodiments, the agent is an agent selected from the group listed in Table 4. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine.

Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. A variety of radionuclides are available for the production of radioconjugated antibodies. Examples include $^{212}$Bi, $^{64}$Cu, $^{125}$I, $^{131}$I, $^{131}$In, $^{90m}$Tc, $^{90}$Y, $^{186}$Re, and $^{89}$Zr.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. (See WO94/11026).

Table 4 lists some of the exemplary pharmaceutical agents that may be employed in the herein described disclosure but in no way is meant to be an exhaustive list.

TABLE 4

Exemplary Pharmaceutical Agents for Conjugation

CYTOTOXIC AGENTS

Auristatins
Auristatin E
Monomethyl auristatin D (MMAD)
Monomethyl auristatin E (MMAE)
Desmethyl auristatin E (DMAE)
Auristatin F
Monomethyl auristatin F (MMAF)
Desmethyl auristatin F (DMAF)
Auristatin derivatives, e.g., amides thereof
Auristatin tyramine
Auristatin quinolone
Dolastatins
Dolastatin derivatives
Dolastatin 16 DmJ
Dolastatin 16 Dpv
Maytansinoids, e.g. DM-1; DM-4
Maytansinoid derivatives
Duocarmycin
Duocarmycin derivatives
Alpha-amanitin
Anthracyclines
Doxorubicin
Daunorubicin
Bryostatins
Camptothecin
Camptothecin derivatives
7-substituted Camptothecin
10,11-Difluoromethylenedioxycamptothecin
Combretastatins
Debromoaplysiatoxin
Kahalalide-F
Discodermolide
Ecteinascidins
ANTIVIRALS Acyclovir
Vira A
Symmetrel
ANTIFUNGALS Nystatin
ADDITIONAL ANTI-NEOPLASTICS Adriamycin
Cerubidine
Bleomycin
Alkeran
Velban
Oncovin
Fluorouracil
Methotrexate
Thiotepa
Bisantrene
Novantrone
Thioguanine
Procarabizine
Cytarabine
ANTI-BACTERIALS Aminoglycosides
Streptomycin
Neomycin
Kanamycin
Amikacin
Gentamicin
Tobramycin
Streptomycin B
Spectinomycin
Ampicillin
Sulfanilamide
Polymyxin
Chloramphenicol
Turbostatin
Phenstatins
Hydroxyphenstatin

TABLE 4-continued

Exemplary Pharmaceutical Agents for Conjugation

Spongistatin 5
Spongistatin 7
Halistatin 1
Halistatin 2
Halistatin 3
Modified Bryostatins
Halocomstatins
Pyrrolobenzimidazoles (PBI)
Cibrostatin6
Doxaliform
Anthracyclins analogues
Cemadotin analogue (CemCH2-SH)
*Pseudomonas* toxin A (PE38) variant
*Pseudomonas* toxin A (ZZ-PE38) variant
ZJ-101
OSW-1
4-Nitrobenzyloxycarbonyl Derivatives of
O6-Benzylguanine
Topoisomerase inhibitors
Hemiasterlin
Cephalotaxine
Homoharringtonine
Pyrrolobenzodiazepine dimers (PBDs)
Functionalized pyrrolobenzodiazepenes
Calicheamicins
Podophyllotoxins
Taxanes
Vinca alkaloids
CONJUGATABLE DETECTION REAGENTS Fluorescein and derivatives thereof
Fluorescein isothiocyanate (FITC)
RADIOPHARMACEUTICALS $^{125}$I
$^{131}$I
$^{89}$Zr
$^{111}$In
$^{123}$I
$^{131}$I
$^{99m}$Tc
$^{201}$Tl
$^{133}$Xe
$^{11}$C
$^{62}$Cu
$^{18}$F
$^{68}$Ga
$^{13}$N
$^{15}$O
$^{38}$K
$^{82}$Rb
$^{99m}$Tc (Technetium)
HEAVY METALS Barium
Gold
Platinum
ANTI-MYCOPLASMALS Tylosine
Spectinomycin Those of ordinary skill in the art will recognize that a large variety of possible moieties can be coupled to the resultant anti-CD3ε antibodies, activatable antibodies, multispecific antibodies and/or multispecific activatable antibodies of the disclosure. (See, for example, "Conjugate Vaccines", Contributions to Microbiology and Immunology, J. M. Cruse and R. E. Lewis, Jr (eds), Carger Press, New York, (1989), the entire contents of which are incorporated herein by reference).

Coupling may be accomplished by any chemical reaction that will bind the two molecules so long as the antibody and the other moiety retain their respective activities. This linkage can include many chemical mechanisms, for instance covalent binding, affinity binding, intercalation, coordinate binding and complexation. In some embodiments, the preferred binding is, however, covalent binding. Covalent binding can be achieved either by direct condensation of existing side chains or by the incorporation of external bridging molecules. Many bivalent or polyvalent linking agents are useful in coupling protein molecules, such as the antibodies of the present disclosure, to other molecules. For example, representative coupling agents can include organic compounds such as thioesters, carbodiimides, succinimide esters, diisocyanates, glutaraldehyde, diazobenzenes and hexamethylene diamines. This listing is not intended to be exhaustive of the various classes of coupling agents known in the art but, rather, is exemplary of the more common coupling agents. (See Killen and Lindstrom, Jour. Immun. 133:1335-2549 (1984); Jansen et al., Immunological Reviews 62:185-216 (1982); and Vitetta et al., Science 238:1098 (1987).

In some embodiments, in addition to the compositions and methods provided herein, the conjugated activatable antibody can also be modified for site-specific conjugation through modified amino acid sequences inserted or otherwise included in the activatable antibody sequence. These modified amino acid sequences are designed to allow for controlled placement and/or dosage of the conjugated agent within a conjugated activatable antibody. For example, the activatable antibody can be engineered to include cysteine substitutions at positions on light and heavy chains that provide reactive thiol groups and do not negatively impact protein folding and assembly, nor alter antigen binding. In some embodiments, the activatable antibody can be engineered to include or otherwise introduce one or more non-natural amino acid residues within the activatable antibody to provide suitable sites for conjugation. In some embodiments, the activatable antibody can be engineered to include or otherwise introduce enzymatically activatable peptide sequences within the activatable antibody sequence.

Suitable linkers are described in the literature. (See, for example, Ramakrishnan, S. et al., Cancer Res. 44:201-208 (1984) describing use of MBS (M-maleimidobenzoyl-N-hydroxysuccinimide ester). See also, U.S. Pat. No. 5,030,719, describing use of halogenated acetyl hydrazide derivative coupled to an antibody by way of an oligopeptide linker. Particularly suitable linkers include: (i) SMPT (4-succinimidyloxycarbonyl-alpha-methyl-alpha-(2-pridyl-dithio)-toluene (Pierce Chem. Co., Cat. (21558G); (ii) SPDP (succinimidyl-6 [3-(2-pyridyldithio) propionamido]hexanoate (Pierce Chem. Co., Cat #21651G); and (iii) Sulfo-LC-SPDP (sulfosuccinimidyl 6 [3-(2-pyridyldithio)-propianamide] hexanoate (Pierce Chem. Co. Cat. #2165-G. Additional linkers include, but are not limited to, SMCC, sulfo-SMCC, SPDB, or sulfo-SPDB.

The linkers described above contain components that have different attributes, thus leading to conjugates with differing physio-chemical properties. For example, the linker SMPT contains a sterically hindered disulfide bond, and can form conjugates with increased stability. Disulfide linkages, are in general, less stable than other linkages because the disulfide linkage is cleaved in vitro, resulting in less conjugate available.

The reagent EDC (1-ethyl-3-(3-dimethylaminopropyl) carbodiimide hydrochloride is useful to create a carboxamide starting with a carboxylic acid and a primary or secondary amine. Thus, EDC may be used to link lysine residues in an antibody with a carboxylic acid in a linker or toxin, or to link aspartate or glutamate residues in an antibody with an amine in a linker or toxin. Such conjugation reactions utilizing EDC may be enhanced by addition of NHS (N-hydroxysuccinimide) or sulfo-NHS (N-hydroxy-3-oxysulfonylsuccinimide). Addition of NHS or sulfo-NHS to such conjugation reactions may enhance the rate, completeness, selectivity, and/or reproducibility of the conjugation reactions.

In some embodiments, the linkers are cleavable. In some embodiments, the linkers are non-cleavable. In some embodiments, two or more linkers are present. The two or more linkers are all the same, e.g., cleavable or non-cleavable, or the two or more linkers are different, e.g., at least one cleavable and at least one non-cleavable.

The present disclosure utilizes several methods for attaching agents to Abs of the anti-CD3ε antibodies, activatable antibodies, multispecific antibodies and/or multispecific activatable antibodies: (a) attachment to the carbohydrate moieties of the AB, or (b) attachment to sulfhydryl groups of the AB, or (c) attachment to amino groups of the AB, or (d) attachment to carboxylate groups of the AB. According to the disclosure, ABs may be covalently attached to an agent through an intermediate linker having at least two reactive groups, one to react with AB and one to react with the agent. The linker, which may include any compatible organic compound, can be chosen such that the reaction with AB (or agent) does not adversely affect AB reactivity and selectivity. Furthermore, the attachment of linker to agent might not destroy the activity of the agent. Suitable linkers for reaction with oxidized antibodies or oxidized antibody fragments include those containing an amine selected from the group consisting of primary amine, secondary amine, hydrazine, hydrazide, hydroxylamine, phenylhydrazine, semicarbazide and thiosemicarbazide groups. Such reactive functional groups may exist as part of the structure of the linker, or may be introduced by suitable chemical modification of linkers not containing such groups.

According to the present disclosure, suitable linkers for attachment to reduced ABs of the anti-CD3ε antibodies, activatable antibodies, multispecific antibodies and/or multispecific activatable antibodies include those having certain reactive groups capable of reaction with a sulfhydryl group of a reduced antibody or fragment. Such reactive groups include, but are not limited to: reactive haloalkyl groups (including, for example, haloacetyl groups), p-mercuribenzoate groups and groups capable of Michael-type addition reactions (including, for example, maleimides and groups of the type described by Mitra and Lawton, 1979, J. Amer. Chem. Soc. 101: 3097-3110).

According to the present disclosure, suitable linkers for attachment to neither oxidized nor reduced ABs of the anti-CD3ε antibodies, activatable antibodies, multispecific antibodies and/or multispecific activatable antibodies include those having certain functional groups capable of reaction with the primary amino groups present in unmodified lysine residues in the AB. Such reactive groups include, but are not limited to, NHS carboxylic or carbonic esters, sulfo-NHS carboxylic or carbonic esters, 4-nitrophenyl carboxylic or carbonic esters, pentafluorophenyl carboxylic or carbonic esters, acyl imidazoles, isocyanates, and isothiocyanates.

According to the present disclosure, suitable linkers for attachment to neither oxidized nor reduced ABs include those having certain functional groups capable of reaction with the carboxylic acid groups present in aspartate or glutamate residues in the AB, which have been activated with suitable reagents. Suitable activating reagents include EDC, with or without added NHS or sulfo-NHS, and other dehydrating agents utilized for carboxamide formation. In these instances, the functional groups present in the suitable linkers would include primary and secondary amines, hydrazines, hydroxylamines, and hydrazides.

The agent may be attached to the linker before or after the linker is attached to the AB. In certain applications it may be desirable to first produce an AB-linker intermediate in which the linker is free of an associated agent. Depending upon the particular application, a specific agent may then be covalently attached to the linker. In other embodiments the AB is first attached to the MM, CM and associated linkers and then attached to the linker for conjugation purposes.

Branched Linkers:

In specific embodiments, branched linkers that have multiple sites for attachment of agents are utilized. For multiple site linkers, a single covalent attachment to an AB would result in an AB-linker intermediate capable of binding an agent at a number of sites. The sites may be aldehyde or sulfhydryl groups or any chemical site to which agents can be attached.

In some embodiments, higher specific activity (or higher ratio of agents to AB) can be achieved by attachment of a single site linker at a plurality of sites on the AB. This plurality of sites may be introduced into the AB by either of two methods. First, one may generate multiple aldehyde groups and/or sulfhydryl groups in the same AB. Second, one may attach to an aldehyde or sulfhydryl of the AB a "branched linker" having multiple functional sites for subsequent attachment to linkers. The functional sites of the branched linker or multiple site linker may be aldehyde or sulfhydryl groups, or may be any chemical site to which linkers may be attached. Still higher specific activities may be obtained by combining these two approaches; that is, attaching multiple site linkers at several sites on the AB.

Cleavable Linkers:

Peptide linkers that are susceptible to cleavage by enzymes of the complement system, such as but not limited to urokinase, tissue plasminogen activator, trypsin, plasmin, or another enzyme having proteolytic activity may be used in one embodiment of the present disclosure. According to one method of the present disclosure, an agent is attached via a linker susceptible to cleavage by complement. The antibody is selected from a class that can activate complement. The antibody-agent conjugate, thus, activates the complement cascade and releases the agent at the target site. According to another method of the present disclosure, an agent is attached via a linker susceptible to cleavage by enzymes having a proteolytic activity such as a urokinase, a tissue plasminogen activator, plasmin, or trypsin. These cleavable linkers are useful in conjugated activatable antibodies that include an extracellular toxin, e.g., by way of non-limiting example, any of the extracellular toxins shown in Table 4.

Non-liming examples of cleavable linker sequences are provided in Table 5.

TABLE 5

Exemplary Linker Sequences for Conjugation

| Types of Cleavable Sequences | Amino Acid Sequence |
|---|---|
| Plasmin cleavable sequences | |
| Pro-urokinase | PRFKIIGG (SEQ ID NO: 342) |
| | PRFRIIGG (SEQ ID NO: 343) |
| TGFβ | SSRHRRALD (SEQ ID NO: 344) |
| Plasminogen | RKSSIIIRMRDVVL (SEQ ID NO: 345) |
| Staphylokinase | SSSFDKGKYKKGDDA (SEQ ID NO: 346) |
| | SSSFDKGKYKRGDDA (SEQ ID NO: 347) |
| Factor Xa cleavable sequences | IEGR (SEQ ID NO: 348) |
| | IDGR (SEQ ID NO: 349) |
| | GGSIDGR (SEQ ID NO: 350) |
| MMP cleavable sequences | |
| Gelatinase A | PLGLWA (SEQ ID NO: 351) |
| Collagenase cleavable sequences | |
| Calf skin collagen (α1(I) chain) | GPQGIAGQ (SEQ ID NO: 352) |
| Calf skin collagen (α2(I) chain) | GPQGLLGA (SEQ ID NO: 353) |
| Bovine cartilage collagen (α1(II) chain) | GIAGQ (SEQ ID NO: 354) |
| Human liver collagen (α1(III) chain) | GPLGIAGI (SEQ ID NO: 355) |
| Human α$_2$M | GPEGLRVG (SEQ ID NO: 356) |
| Human PZP | YGAGLGVV (SEQ ID NO: 357) |
| | AGLGVVER (SEQ ID NO: 358) |
| | AGLGISST (SEQ ID NO: 359) |
| Rat α$_1$M | EPQALAMS (SEQ ID NO: 360) |
| | QALAMSAI (SEQ ID NO: 361) |
| Rat α$_2$M | AAYHLVSQ (SEQ ID NO: 362) |
| | MDAFLESS (SEQ ID NO: 363) |
| Rat α$_1$I$_3$(2J) | ESLPVVAV (SEQ ID NO: 364) |
| Rat α$_1$I$_3$(27J) | SAPAVESE (SEQ ID NO: 365) |
| Human fibroblast collagenase | DVAQFVLT (SEQ ID NO: 366) |
| (autolytic cleavages) | VAQFVLTE (SEQ ID NO: 367) |
| | AQFVLTEG (SEQ ID NO: 368) |
| | PVQPIGPQ (SEQ ID NO: 369) |

In addition, agents may be attached via disulfide bonds (for example, the disulfide bonds on a cysteine molecule) to the AB. Since many tumors naturally release high levels of glutathione (a reducing agent) this can reduce the disulfide bonds with subsequent release of the agent at the site of delivery. In certain specific embodiments the reducing agent that would modify a CM would also modify the linker of the conjugated activatable antibody.

Spacers and Cleavable Elements: In still another embodiment, it may be necessary to construct the linker in such a way as to optimize the spacing between the agent and the AB of the activatable antibody. This may be accomplished by use of a linker of the general structure:

wherein
W is either —NH—CH$_2$— or —CH$_2$—;
Q is an amino acid, peptide; and
n is an integer from 0 to 20.

In still other embodiments, the linker may comprise a spacer element and a cleavable element. The spacer element serves to position the cleavable element away from the core of the AB such that the cleavable element is more accessible to the enzyme responsible for cleavage. Certain of the branched linkers described above may serve as spacer elements.

Throughout this discussion, it should be understood that the attachment of linker to agent (or of spacer element to cleavable element, or cleavable element to agent) need not be particular mode of attachment or reaction. Any reaction providing a product of suitable stability and biological compatibility is acceptable.

Serum Complement and Selection of Linkers:

According to one method of the present disclosure, when release of an agent is desired, an AB that is an antibody of a class that can activate complement is used. The resulting conjugate retains both the ability to bind antigen and activate the complement cascade. Thus, according to this embodiment of the present disclosure, an agent is joined to one end of the cleavable linker or cleavable element and the other end of the linker group is attached to a specific site on the AB. For example, if the agent has an hydroxy group or an amino group, it may be attached to the carboxy terminus of a peptide, amino acid or other suitably chosen linker via an ester or amide bond, respectively. For example, such agents may be attached to the linker peptide via a carbodimide reaction. If the agent contains functional groups that would interfere with attachment to the linker, these interfering functional groups can be blocked before attachment and deblocked once the product conjugate or intermediate is made. The opposite or amino terminus of the linker is then used either directly or after further modification for binding to an AB that is capable of activating complement.

Linkers (or spacer elements of linkers) may be of any desired length, one end of which can be covalently attached to specific sites on the AB of the activatable antibody. The other end of the linker or spacer element may be attached to an amino acid or peptide linker.

Thus when these conjugates bind to antigen in the presence of complement the amide or ester bond that attaches the agent to the linker will be cleaved, resulting in release of the agent in its active form. These conjugates, when administered to a subject, will accomplish delivery and release of the agent at the target site, and are particularly effective for the in vivo delivery of pharmaceutical agents, antibiotics, antimetabolites, antiproliferative agents and the like as presented in but not limited to those in Table 4.

Linkers for Release without Complement Activation:

In yet another application of targeted delivery, release of the agent without complement activation is desired since activation of the complement cascade will ultimately lyse the target cell. Hence, this approach is useful when delivery and release of the agent should be accomplished without killing the target cell. Such is the goal when delivery of cell mediators such as hormones, enzymes, corticosteroids, neurotransmitters, genes or enzymes to target cells is desired. These conjugates may be prepared by attaching the agent to an AB that is not capable of activating complement via a linker that is mildly susceptible to cleavage by serum proteases. When this conjugate is administered to an individual, antigen-antibody complexes will form quickly whereas cleavage of the agent will occur slowly, thus resulting in release of the compound at the target site.

Biochemical Cross Linkers:

In other embodiments, the activatable antibody may be conjugated to one or more therapeutic agents using certain biochemical cross-linkers. Cross-linking reagents form molecular bridges that tie together functional groups of two different molecules. To link two different proteins in a step-wise manner, hetero-bifunctional cross-linkers can be used that eliminate unwanted homopolymer formation.

Peptidyl linkers cleavable by lysosomal proteases are also useful, for example, Val-Cit, Val-Ala or other dipeptides. In addition, acid-labile linkers cleavable in the low-pH environment of the lysosome may be used, for example: bissialyl ether. Other suitable linkers include cathepsin-labile substrates, particularly those that show optimal function at an acidic pH.

Exemplary hetero-bifunctional cross-linkers are referenced in Table 6.

TABLE 6

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
| SMPT | Primary amines Sulfhydryls | Greater stability | 11.2 Å |
| SPDP | Primary amines Sulfhydryls | Thiolation Cleavable cross-linking | 6.8 Å |
| LC-SPDP | Primary amines Sulfhydryls | Extended spacer arm | 15.6 Å |
| Sulfo-LC-SPDP | Primary amines Sulfhydryls | Extender spacer arm Water-soluble | 15.6 Å |
| SMCC | Primary amines | Stable maleimide reactive group | 11.6 Å |

TABLE 6-continued

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
|  | Sulfhydryls | Enzyme-antibody conjugation Hapten-carrier protein conjugation |  |
| Sulfo-SMCC | Primary amines | Stable maleimide reactive group | 11.6 Å |
|  | Sulfhydryls | Water-soluble Enzyme-antibody conjugation |  |
| MBS | Primary amines Sulfhydryls | Enzyme-antibody conjugation Hapten-carrier protein conjugation | 9.9 Å |
| Sulfo-MBS | Primary amines Sulfhydryls | Water-soluble | 9.9 Å |
| SIAB | Primary amines Sulfhydryls | Enzyme-antibody conjugation | 10.6 Å |
| Sulfo-SIAB | Primary amines Sulfhydryls | Water-soluble | 10.6 Å |
| SMPB | Primary amines Sulfhydryls | Extended spacer arm Enzyme-antibody conjugation | 14.5 Å |
| Sulfo-SMPB | Primary amines Sulfhydryls | Extended spacer arm Water-soluble | 14.5 Å |
| EDE/Sulfo-NHS | Primary amines Carboxyl groups | Hapten-Carrier conjugation | 0 |
| ABH | Carbohydrates Nonselective | Reacts with sugar groups | 11.9 Å |

Non-Cleavable Linkers or Direct Attachment:

In still other embodiments of the disclosure, the conjugate may be designed so that the agent is delivered to the target but not released. This may be accomplished by attaching an agent to an AB either directly or via a non-cleavable linker.

These non-cleavable linkers may include amino acids, peptides, D-amino acids or other organic compounds that may be modified to include functional groups that can subsequently be utilized in attachment to ABs by the methods described herein. A-general formula for such an organic linker could be

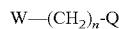

wherein
W is either —NH—CH$_2$— or —CH$_2$—;
Q is an amino acid, peptide; and
n is an integer from 0 to 20.

Non-Cleavable Conjugates:

In some embodiments, a compound may be attached to ABs that do not activate complement. When using ABs that are incapable of complement activation, this attachment may be accomplished using linkers that are susceptible to cleavage by activated complement or using linkers that are not susceptible to cleavage by activated complement.

The antibodies disclosed herein can also be formulated as immunoliposomes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present disclosure can be conjugated to the liposomes as described in Martin et al., J. Biol. Chem., 257: 286-288 (1982) via a disulfide-interchange reaction.

Activatable Antibodies and Multispecific Activatable Antibodies Having Non-Binding Steric Moieties or Binding Partners for Non-Binding Steric Moieties The disclosure also provides activatable antibodies and/or multispecific activatable antibodies that include non-binding steric moieties (NB) or binding partners (BP) for non-binding steric moieties, where the BP recruits or otherwise attracts the NB to the activatable antibody and/or multispecific activatable antibody. The activatable antibodies provided herein include, for example, an activatable antibody that includes a non-binding steric moiety (NB), a cleavable linker (CL) and an antibody or antibody fragment (AB) that binds a first target or epitope; a multispecific activatable antibody that includes a binding partner for a non-binding steric moiety (BP), a CL and an AB; and a multispecific activatable antibody that includes a BP to which an NB has been recruited, a CL and AB that binds a first target or epitope. The multispecific activatable antibodies provided herein include, for example, a multispecific activatable antibody that includes a non-binding steric moiety (NB), a cleavable linker (CL) and at least a first antibody or antibody fragment (AB1) that binds a first target or epitope; a multispecific activatable antibody that includes a binding partner for a non-binding steric moiety (BP), a CL and an AB1; and a multispecific activatable antibody that includes a BP to which an NB has been recruited, a CL and AB1 that binds a first target or epitope. Activatable antibodies in which the NB is covalently linked to the CL and AB or is associated by interaction with a BP that is covalently linked to the CL and AB are referred to herein as "NB-containing activatable antibodies." Multispecific activatable antibodies in which the NB is covalently linked to the CL and AB1 or is associated by interaction with a BP that is covalently linked to the CL and AB1 are referred to herein as "NB-containing multispecific activatable antibodies." By activatable or switchable is meant that the activatable antibody exhibits a first level of binding to a target when the activatable antibody is in an inhibited, masked or uncleaved state (i.e., a first conformation), and a second level of binding to the target when the activatable antibody is in an uninhibited, unmasked and/or cleaved state (i.e., a second conformation, i.e., activated antibody), where the second level of target binding is greater than the first level of target binding. The activatable antibody and/or multispecific activatable antibody compositions can exhibit increased bioavailability and more favorable biodistribution compared to conventional antibody therapeutics.

In some embodiments, activatable antibodies and/or multispecific activatable antibodies provide for reduced toxicity and/or adverse side effects that could otherwise result from binding of the activatable antibody and/or multispecific activatable antibody at non-treatment sites and/or non-diagnostic sites if the activatable antibody and/or multispecific activatable antibody were not masked or otherwise inhibited from binding to such a site.

Anti-CD3ε activatable antibodies that include a non-binding steric moiety (NB) can be made using the methods set forth in PCT Publication No. WO 2013/192546, the contents of which are hereby incorporated by reference in their entirety.

Use of Anti-CD3e, Activatable Antibodies, Multispecific Antibodies and Multispecific Activatable Antibodies It will be appreciated that administration of therapeutic entities in accordance with the disclosure will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences (15th ed., Mack Publishing Company, Easton, Pa. (1975)), particularly Chapter 87 by Blaug, Seymour, therein. These formulations include, for example, powders, pastes, ointments, jellies, waxes, oils, lipids, lipid (cationic or anionic) containing vesicles (such as Lipofectin™), DNA conjugates, anhydrous absorption pastes, oil-in-water and water-in-oil emulsions, emulsions carbowax (polyethylene glycols of various molecular weights), semisolid gels, and semi-solid mixtures containing carbowax. Any of the foregoing mixtures may be appropriate in treatments and therapies in accordance with the present disclosure, provided that the active ingredient in the formulation is not inactivated by the formulation and the formulation is physiologically compatible and tolerable with the route of administration. See also Baldrick P. "Pharmaceutical excipient development: the need for preclinical guidance." Regul. Toxicol Pharmacol. 32(2):210-8 (2000), Wang W. "Lyophilization and development of solid protein pharmaceuticals." Int. J. Pharm. 203(1-2):1-60 (2000), Charman W N "Lipids, lipophilic drugs, and oral drug delivery-some emerging concepts." J Pharm Sci. 89(8):967-78 (2000), Powell et al. "Compendium of excipients for parenteral formulations" PDA J Pharm Sci Technol. 52:238-311 (1998) and the citations therein for additional information related to formulations, excipients and carriers well known to pharmaceutical chemists.

In one embodiment, an anti-CD3ε antibody, an activatable antibody, a multispecific antibody and/or a multispecific activatable antibody of the disclosure may be used as therapeutic agents. Such agents will generally be employed to diagnose, prognose, monitor, treat, alleviate, and/or prevent a disease or pathology in a subject. A therapeutic regimen is carried out by identifying a subject, e.g., a human patient or other mammal suffering from (or at risk of developing) a disorder using standard methods. An anti-CD3ε antibody and/or an activatable antibody preparation is administered to the subject and will generally have an effect due to its binding with the CD3ε. A multispecific antibody and/or a multispecific activatable antibody preparation, for example in some embodiments, one having high specificity and high affinity for its two or more target antigens, is administered to the subject and will generally have an effect due to its binding with the targets. Administration of anti-CD3ε antibody, an activatable antibody, a multispecific antibody and/or a multispecific activatable antibody may activate T cells via engagement of CD3ε on the T cells. Administration of anti-CD3ε antibody, an activatable antibody, a multispecific antibody and/or a multispecific activatable antibody may agonize, stimulate, activate, and/or augment CD3-mediated T cell activation.

Generally, alleviation or treatment of a disease or disorder involves the lessening of one or more symptoms or medical problems associated with the disease or disorder. For example, in the case of cancer, the therapeutically effective amount of the drug can accomplish one or a combination of the following: reduce the number of cancer cells; reduce the tumor size; inhibit (i.e., to decrease to some extent and/or stop) cancer cell infiltration into peripheral organs; inhibit tumor metastasis; inhibit, to some extent, tumor growth; and/or relieve to some extent one or more of the symptoms associated with the cancer. In some embodiments, a composition of this disclosure can be used to prevent the onset or reoccurrence of the disease or disorder in a subject, e.g., a human or other mammal, such as a non-human primate, companion animal (e.g., cat, dog, horse), farm animal, work animal, or zoo animal. The terms subject and patient are used interchangeably herein.

A therapeutically effective amount of an anti-CD3ε antibody, an activatable antibody, a multispecific antibody and/or a multispecific activatable antibody of the disclosure relates generally to the amount needed to achieve a therapeutic objective. As noted above, this may be a binding interaction between the anti-CD3ε antibody, the activatable antibody, the multispecific antibody and/or a multispecific activatable antibody and its target antigens that, in certain cases, agonize, stimulate, activate, and/or augment CD3-mediated T cell activation. The amount required to be administered will furthermore depend on the binding affinity of the anti-CD3ε antibody, the activatable antibody, the multispecific antibody and/or a multispecific activatable antibody for its specific antigen, and will also depend on the rate at which an administered anti-CD3ε antibody, activatable antibody, multispecific antibody and/or multispecific activatable antibody is depleted from the free volume other subject to which it is administered. Common ranges for therapeutically effective dosing of an anti-CD3ε antibody, an activatable antibody, a multispecific antibody and/or antibody fragment and/or a multispecific activatable antibody of the disclosure may be, by way of nonlimiting example, from about 0.01 μg/kg body weight to about 10 mg/kg body weight. In some embodiments, the therapeutically effective dosing of an anti-CD3ε antibody, an activatable antibody, a multispecific antibody and/or antibody fragment and/or a multispecific activatable antibody of the disclosure may be, by way of nonlimiting example, from about 0.01 mg/kg body weight to about 5-10 mg/kg body weight. Common dosing frequencies may range, for example, from twice daily to once a week.

Efficaciousness of treatment is determined in association with any known method for diagnosing or treating the particular disorder. Methods for the screening of anti-CD3ε antibodies, activatable antibodies, multispecific antibodies and/or multispecific activatable antibodies that possess the desired specificity include, but are not limited to, enzyme linked immunosorbent assay (ELISA) and other immunologically mediated techniques known within the art.

In another embodiment, an anti-CD3ε antibody, an activatable antibody, a multispecific antibody and/or a multispecific activatable antibody directed two or more targets are used in methods known within the art relating to the localization and/or quantitation of the targets (e.g., for use in measuring levels of one or more of the targets within appropriate physiological samples, for use in diagnostic methods, for use in imaging the protein, and the like). In a given embodiment, an anti-CD3ε antibody, an activatable antibody, a multispecific antibody and/or a multispecific activatable antibody directed two or more targets, or a derivative, fragment, analog or homolog thereof, that contain the antibody derived antigen binding domain, are utilized as pharmacologically active compounds (referred to hereinafter as "Therapeutics").

In another embodiment, an anti-CD3ε antibody, an activatable antibody, a multispecific antibody and/or a multispecific activatable antibody directed two or more targets is used to isolate one or more of the targets by standard techniques, such as immunoaffinity, chromatography or immunoprecipitation. An anti-CD3ε antibody, an activatable antibody, a multispecific antibody and/or a multispecific activatable antibody directed two or more targets (or a fragment thereof) are used diagnostically to monitor protein levels in tissue as part of a clinical testing procedure, e.g., to determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{121}$I, $^{131}$I, $^{35}$S or $^{3}$H.

In yet another embodiment, an anti-CD3ε antibody, an activatable antibody, a multispecific antibody and/or a multispecific activatable antibody directed two or more targets can be used as an agent for detecting the presence of one or more of the targets (or a fragment thereof) in a sample. In some embodiments, the antibody contains a detectable label. Antibodies are polyclonal, or in some embodiments, monoclonal. An intact antibody, or a fragment thereof (e.g., $F_{ab}$, scFv, or $F_{(ab)2}$) is used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of an antibody with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the disclosure can be used to detect a protein in a biological sample in vitro as well as in vivo. For example, in vitro techniques for detection of an analyte protein include enzyme linked immunosorbent assays (ELISAs), Western blots, immunoprecipitations, and immunofluorescence. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Theory of Enzyme Immunoassays", P. Tijssen, Elsevier Science Publishers, Amsterdam, 1985. Furthermore, in vivo techniques for detection of an analyte protein include introducing into a subject a labeled anti-analyte protein antibody. For example, the antibody can be labeled with a radioactive marker whose presence and location in a subject can be detected by standard imaging techniques.

The anti-CD3ε antibody, the activatable antibody, the multispecific antibodies and/or multispecific activatable antibodies of the disclosure are also useful in a variety of diagnostic and prophylactic formulations. In one embodiment, an anti-CD3ε antibody, an activatable antibody, a multispecific antibody and/or multispecific activatable antibody is administered to patients that are at risk of developing one or more of the aforementioned disorders. A patient's or organ's predisposition to one or more of the disorders can be determined using genotypic, serological or biochemical markers.

In another embodiment of the disclosure, an anti-CD3ε antibody, an activatable antibody, a multispecific antibody and/or multispecific activatable antibody is administered to human individuals diagnosed with a clinical indication associated with one or more of the aforementioned disorders. Upon diagnosis, an anti-CD3ε antibody, an activatable antibody, a multispecific antibody and/or multispecific activatable antibody is administered to mitigate or reverse the effects of the clinical indication.

Anti-CD3ε antibodies, activatable antibodies, multispecific antibodies and/or multispecific activatable antibodies are also useful in the detection of one or more targets in patient samples and accordingly are useful as diagnostics. For example, the anti-CD3ε antibodies, the activatable antibodies, the multispecific antibodies and/or multispecific activatable antibodies of the disclosure are used in in vitro assays, e.g., ELISA, to detect one or more target levels in a patient sample.

In one embodiment, an anti-CD3ε antibody, an activatable antibody, a multispecific antibody and/or multispecific activatable antibody is immobilized on a solid support (e.g., the well(s) of a microtiter plate). The immobilized antibody and/or activatable antibody serves as a capture antibody for any target(s) that may be present in a test sample. Prior to contacting the immobilized anti-CD3ε antibody, activatable antibody, multispecific antibody and/or immobilized multispecific activatable antibody with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen(s) in the test sample is determined by comparison with a standard curve developed from the standard samples.

It will be appreciated that based on the results obtained using the anti-CD3ε antibody, the activatable antibody, the multispecific antibody and/or multispecific activatable antibody in an in vitro diagnostic assay, it is possible to stage a disease in a subject based on expression levels of the target antigen(s). For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that may be considered characteristic of each stage is designated.

Anti-CD3ε antibodies, activatable antibodies, multispecific antibodies and/or multispecific activatable antibodies can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies and/or multispecific activatable antibodies having an enzymatically cleavable CM can be used to detect the presence or absence of an enzyme that is capable of cleaving the CM. Such activatable antibodies and/or multispecific activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of multispecific activated antibodies (i.e., antibodies resulting from cleavage of an activatable antibody and/or a multispecific activatable antibody) in a given cell or tissue of a given host organism. Such accumulation of activated multispecific antibodies indicates not only that the tissue expresses enzymatic activity (or an increased reduction potential depending on the nature of the CM) but also that the tissue expresses at least one target to which the activated antibody binds.

For example, the CM can be selected to be a protease substrate for a protease found at the site of a tumor, at the site of a viral or bacterial infection at a biologically confined site (e.g., such as in an abscess, in an organ, and the like), and the like. At least one of the AB can be one that binds a target antigen. Using methods familiar to one skilled in the art, a detectable label (e.g., a fluorescent label or radioactive label or radiotracer) can be conjugated to an AB or other region of a multispecific antibody and/or multispecific activatable antibody. Suitable detectable labels are discussed in the context of the above screening methods and additional specific examples are provided below. Using at least one AB specific to a protein or peptide of the disease state, along with a protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated multispecific antibodies in the disease tissue is enhanced relative to non-disease tissues.

In another example, activatable antibodies and/or activatable multispecific antibodies can be used to detect the presence or absence of a cleaving agent in a sample. For example, where the activatable antibodies and/or multispecific activatable antibodies contain a CM susceptible to cleavage by an enzyme, the multispecific activatable antibodies can be used to detect (either qualitatively or quantitatively) the presence of an enzyme in the sample. In another example, where the activatable antibodies and/or multispecific activatable antibodies contain a CM susceptible to cleavage by reducing agent, the activatable antibodies and/or multispecific activatable antibodies can be used to detect (either qualitatively or quantitatively) the presence of reducing conditions in a sample. To facilitate analysis in these methods, the activatable antibodies and/or multispecific activatable antibodies can be detectably labeled, and can be bound to a support (e.g., a solid support, such as a slide or bead). The detectable label can be positioned on a portion of the activatable antibody and/or multispecific activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies and/or multispecific activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies and/or multispecific activatable antibodies prior to contacting with the sample e.g., the presence of and/or an increase in detectable signal due to cleavage of the activatable antibody and/or multispecific activatable antibody by the cleaving agent in the sample.

Such detection methods can be adapted to also provide for detection of the presence or absence of a target that is capable of binding at least one AB of the multispecific activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the multispecific activatable antibodies as described above, and the presence or absence of the target can be detected by detection of a target-AB complex e.g., by use of a detectably labeled anti-target antibody.

Activatable antibodies and/or multispecific activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody and/or multispecific activatable antibody is labeled with a detectable label. The detectable label may be a fluorescent dye, (e.g. a fluorophore, Fluorescein Isothiocyanate (FITC), Rhodamine Isothiocyanate (TRITC), an Alexa Fluor® label), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, multispecific activatable antibody indicates that the sample contains the target and contains a protease that is specific for the CM of the activatable antibody and/or multispecific activatable antibody. In some embodiments, the presence of the protease can be confirmed using broad spectrum protease inhibitors such as those described herein, and/or by using an agent that is specific for the protease, for example, an antibody such as A11, which is specific for the protease matriptase (MT-SP1) and inhibits the proteolytic activity of matriptase; see e.g., International Publication Number WO 2010/129609, published 11 Nov. 2010. The same approach of using broad spectrum protease inhibitors such as those described herein, and/or by using a more selective inhibitory agent can be used to identify a protease or class of proteases specific for the CM of the activatable antibody and/or multispecific activatable antibody. In some embodiments, the presence of the target can be confirmed using an agent that is specific for the target or the detectable label can be competed with unlabeled target. In some embodiments, unlabeled activatable antibody and/or multispecific activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody and/or multispecific activatable antibody.

These techniques are also useful in kits and/or as reagents for the detection, identification or characterization of protease activity in a variety of cells, tissues, and organisms based on the protease-specific CM in the multispecific activatable antibody.

Therapeutic Administration and Formulations of Anti-CD3ε Antibodies, Activatable Antibodies, Multispecific Antibodies and/or Multispecific Activatable Antibodies It will be appreciated that administration of therapeutic entities in accordance with the disclosure will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences (15th ed., Mack Publishing Company, Easton, Pa. (1975)), particularly Chapter 87 by Blaug, Seymour, therein. These formulations include, for example, powders, pastes, ointments, jellies, waxes, oils, lipids, lipid (cationic or anionic) containing vesicles (such as Lipofectin™), DNA conjugates, anhydrous absorption pastes, oil-in-water and water-in-oil emulsions, emulsions carbowax (polyethylene glycols of various molecular weights), semi-solid gels, and semi-solid mixtures containing carbowax.

Any of the foregoing mixtures may be appropriate in treatments and therapies in accordance with the present disclosure, provided that the active ingredient in the formulation is not inactivated by the formulation and the formulation is physiologically compatible and tolerable with the route of administration. See also Baldrick P. "Pharmaceutical excipient development: the need for preclinical guidance." Regul. Toxicol Pharmacol. 32(2):210-8 (2000), Wang W. "Lyophilization and development of solid protein pharmaceuticals." Int. J. Pharm. 203(1-2):1-60 (2000), Charman W N "Lipids, lipophilic drugs, and oral drug delivery-some emerging concepts." J Pharm Sci. 89(8):967-78 (2000), Powell et al. "Compendium of excipients for parenteral formulations" PDA J Pharm Sci Technol. 52:238-311 (1998) and the citations therein for additional information related to formulations, excipients and carriers well known to pharmaceutical chemists.

In some embodiments, the anti-CD3ε antibodies, the conjugated anti-CD3ε antibodies, the activatable antibodies, the conjugated activatable antibodies, the multispecific antibodies, the multispecific activatable antibodies and/or the conjugated multispecific activatable antibody compositions—referred to collectively herein as the Therapeutic(s)—are administered in conjunction with one or more additional agents, or a combination of additional agents. Suitable additional agents include current pharmaceutical and/or surgical therapies for an intended application. For example, the Therapeutic(s) can be used in conjunction with an additional chemotherapeutic or antineoplastic agent. For example, the Therapeutic(s) and additional agent are formulated into a single therapeutic composition, and the Therapeutic(s) and additional agent are administered simultaneously. In some embodiments, the Therapeutic(s) and additional agent are separate from each other, e.g., each is formulated into a separate therapeutic composition, and the Therapeutic(s) and the additional agent are administered simultaneously, or the Therapeutic(s) and the additional agent are administered at different times during a treatment regimen. For example, the Therapeutic(s) is administered prior to the administration of the additional agent, the Therapeutic(s) is administered subsequent to the administration of the additional agent, or the Therapeutic(s) and the additional agent are administered in an alternating fashion. As described herein, the Therapeutic(s) and additional agent are administered in single doses or in multiple doses.

In some embodiments, the additional agent is coupled or otherwise attached to the Therapeutic(s).

Suitable additional agents are selected according to the purpose of the intended application (i.e., killing, prevention of cell proliferation, hormone therapy or gene therapy). Such agents may include but is not limited to, for example, pharmaceutical agents, toxins, fragments of toxins, alkylating agents, enzymes, antibiotics, antimetabolites, antiproliferative agents, hormones, neurotransmitters, DNA, RNA, siRNA, oligonucleotides, antisense RNA, aptamers, diagnostics, radiopaque dyes, radioactive isotopes, fluorogenic compounds, magnetic labels, nanoparticles, marker compounds, lectins, compounds that alter cell membrane permeability, photochemical compounds, small molecules, liposomes, micelles, gene therapy vectors, viral vectors, and the like. Finally, combinations of agents or combinations of different classes of agents may be used.

The anti-CD3ε antibodies, the conjugated anti-CD3ε antibodies, the activatable antibodies, the conjugated activatable antibodies, the multispecific antibodies, the multispecific activatable antibodies and/or the conjugated multispecific activatable antibody compositions of the disclosure (also referred to herein as "Therapeutic(s)" or "active compounds"), and derivatives, fragments, analogs and homologs thereof, can be incorporated into pharmaceutical compositions suitable for administration. Principles and considerations involved in preparing such compositions, as well as guidance in the choice of components are provided, for example, in Remington's Pharmaceutical Sciences: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

Such compositions typically comprise the anti-CD3ε antibodies, the conjugated anti-CD3ε antibodies, the activatable antibodies, the conjugated activatable antibodies, the multispecific antibodies, the multispecific activatable antibodies and/or the conjugated multispecific activatable antibody compositions and a pharmaceutically acceptable carrier. Where an antibody, activatable antibody, multispecific antibody and/or a multispecific activatable antibody includes a fragment of the AB domain, the smallest fragment of the AB that specifically binds to the binding domain of the target protein can be used. For example, based upon the variable-region sequences of an antibody, peptide molecules can be designed that retain the ability of the AB to bind the target protein sequence. Such peptides can be synthesized chemically and/or produced by recombinant DNA technology. (See, e.g., Marasco et al., Proc. Natl. Acad. Sci. USA, 90: 7889-7893 (1993)).

As used herein, the term "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Suitable examples of such carriers or diluents include, but are not limited to, water, saline, ringer's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated.

The formulations to be used for in vivo administration must be sterile. This is readily accomplished by filtration through sterile filtration membranes.

A pharmaceutical composition of the disclosure is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL' (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be suitable to include isotonic agents, for example, sugars, polyalcohols such as manitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as sustained/controlled release formulations, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art.

For example, the active ingredients can be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

The materials can also be obtained commercially from Alza Corporation and Nova Pharmaceuticals, Inc. Liposomal suspensions (including liposomes targeted to infected cells with monoclonal antibodies to viral antigens) and can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

The formulation can also contain more than one active compound as necessary for the particular indication being treated, for example, those with complementary activities that do not adversely affect each other. In some embodiments, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

In one embodiment, the active compounds are administered in combination therapy, i.e., combined with other agents, e.g., therapeutic agents, that are useful for treating pathological conditions or disorders, such as autoimmune disorders and inflammatory diseases. The term "in combination" in this context means that the agents are given substantially contemporaneously, either simultaneously or sequentially. If given sequentially, at the onset of administration of the second compound, the first of the two compounds is still detectable at effective concentrations at the site of treatment.

For example, the combination therapy can include one or more antibodies of the disclosure coformulated with, and/or coadministered with, one or more additional therapeutic agents, e.g., one or more cytokine and growth factor inhibitors, immunosuppressants, anti-inflammatory agents, metabolic inhibitors, enzyme inhibitors, and/or cytotoxic or cytostatic agents, as described in more detail below. Furthermore, one or more antibodies described herein may be used in combination with two or more of the therapeutic agents described herein. Such combination therapies may advantageously utilize lower dosages of the administered therapeutic agents, thus avoiding possible toxicities or complications associated with the various monotherapies.

In other embodiments, one or more antibodies of the disclosure can be coformulated with, and/or coadministered with, one or more anti-inflammatory drugs, immunosuppressants, or metabolic or enzymatic inhibitors. Nonlimiting examples of the drugs or inhibitors that can be used in combination with the antibodies described herein, include, but are not limited to, one or more of: nonsteroidal anti-inflammatory drug(s) (NSAIDs), e.g., ibuprofen, tenidap, naproxen, meloxicam, piroxicam, diclofenac, and indomethacin; sulfasalazine; corticosteroids such as prednisolone; cytokine suppressive anti-inflammatory drug(s) (CSAIDs); inhibitors of nucleotide biosynthesis, e.g., inhibitors of purine biosynthesis, folate antagonists (e.g., methotrexate (N-[4-[[(2,4-diamino-6-pteridinyl)methyl] methylamino] benzoyl]-L-glutamic acid); and inhibitors of pyrimidine biosynthesis, e.g., dihydroorotate dehydrogenase (DHODH) inhibitors. Suitable therapeutic agents for use in combination with the antibodies of the disclosure include NSAIDs, CSAIDs, (DHODH) inhibitors (e.g., leflunomide), and folate antagonists (e.g., methotrexate).

Examples of additional inhibitors include one or more of: corticosteroids (oral, inhaled and local injection); immunosuppressants, e.g., cyclosporin, tacrolimus (FK-506); and mTOR inhibitors, e.g., sirolimus (rapamycin—RAPAMUNE™ or rapamycin derivatives, e.g., soluble rapamycin derivatives (e.g., ester rapamycin derivatives, e.g., CCI-779); agents that interfere with signaling by proinflammatory cytokines such as TNFα or IL-1 (e.g. IRAK, NIK, IKK, p38 or MAP kinase inhibitors); COX2 inhibitors, e.g., celecoxib, rofecoxib, and variants thereof; phosphodiesterase inhibitors, e.g., R973401 (phosphodiesterase Type IV inhibitor); phospholipase inhibitors, e.g., inhibitors of cytosolic phospholipase 2 (cPLA2) (e.g., trifluoromethyl ketone analogs); inhibitors of vascular endothelial cell growth factor or growth factor receptor, e.g., VEGF inhibitor and/or VEGF-R inhibitor; and inhibitors of angiogenesis. Suitable therapeutic agents for use in combination with the antibodies of the disclosure are immunosuppressants, e.g., cyclosporin, tacrolimus (FK-506); mTOR inhibitors, e.g., sirolimus (rapamycin) or rapamycin derivatives, e.g., soluble rapamycin derivatives (e.g., ester rapamycin derivatives, e.g., CCI-779); COX2 inhibitors, e.g., celecoxib and variants thereof; and phospholipase inhibitors, e.g., inhibitors of cytosolic phospholipase 2 (cPLA2), e.g., trifluoromethyl ketone analogs.

Additional examples of therapeutic agents that can be combined with an antibody of the disclosure include one or more of: 6-mercaptopurines (6-MP); azathioprine sulphasalazine; mesalazine; olsalazine; chloroquine/hydroxychloroquine (PLAQUENIL®); pencillamine; aurothiornalate (intramuscular and oral); azathioprine; coichicine; beta-2 adrenoreceptor agonists (salbutamol, terbutaline, salmeteral); xanthines (theophylline, arninophylline); cromoglycate; nedocromil; ketotifen; ipratropium and oxitropium; mycophenolate mofetil; adenosine agonists; antithrombotic agents; complement inhibitors; and adrenergic agents.

All publications and patent documents cited herein are incorporated herein by reference as if each such publication or document was specifically and individually indicated to be incorporated herein by reference. Citation of publications and patent documents is not intended as an admission that any is pertinent prior art, nor does it constitute any admission as to the contents or date of the same. The invention having now been described by way of written description, those of skill in the art will recognize that the invention can be practiced in a variety of embodiments and that the foregoing description and examples below are for purposes of illustration and not limitation of the claims that follow.

EXAMPLES

Example 1. Activatable Anti-CD3ε Antibody Masking Moieties

This Example describes identification of masking moieties (MM) to reduce binding of activatable anti-CD3ε antibodies to their target.

MACS1 and MACS2 Selections

Anti-CD3ε antibody SP34 (also referred to herein as SP34 antibody) was used to screen a peptide library inserted into a circularly permuted outer membrane protein OmpX in *E. coli* with $6\times10^{10}$ members, using a method similar to the bacterial display technology described in PCT International Publication Numbers WO 2005/047461, published May 26, 2005, and WO 2009/014726, published Jan. 29, 2009. The selection involved two rounds of magnetic activated cell separation (MACS) followed by two different fluorescent activated cell sorting (FACS) based selection strategies. FIG. 1 shows the generic naming scheme for MACS and FACS populations during a selection process: Magnetic activated cell separations (MACS) are denoted with an "M" and fluorescent activated cell sorting (FACS) selections are denoted with an "F". The order of the abbreviation indicates the order of selections/sorts and the number indicates the number of rounds of that type of selection/sort to which that the population has been subjected. For example, an M2F3 population has gone through 2 rounds of MACS selections followed by 3 rounds of FACS selections. The starting population that undergoes selection to yield a given population is assumed to be N−1 of the right most sort indicator in the nomenclature. For example, the population that was sorted to produce the M2F3 population is assumed to have been the M2F2 population.

The initial MACS (M1) was done using protein-G Dynabeads (Invitrogen Cat#: 10003D) and the SP34 antibody (available from BD Biosciences Cat#556610) at a concentration of 100 nM. For the M1, $6\times10^{11}$ cells were screened for binding and $6.6\times10^{7}$ cells were collected. The second round of MACS sorting (M2) was done in a manner similar to the first round with the following differences. The SP34 antibody was added to a final concentration of 50 nM, and a total of $4.5\times10^{11}$ cells were screened for binding and $3.1\times10^{5}$ cells were collected.

FACS Selections

Selection #1

For all FACS selections, 50 μl of induced culture were spun down (5 min @ 3000×g) and labeled with the indicated concentration of antibody. For the M2, MACS2FACS1 (M2F1), and MACS2FACS2 (M2F2) selections cells were labeled with 1 nM of SP34-dylight-488 (ThermoScientific Cat#: 53025) in 500 μl PBS, 0.5% BSA, and the top 0.5% of positive cells were sorted by fluorescent activated cell sorting (FACS) using a FACSARIAI instrument (BD Biosciences). For the M2 sort, $3\times10^{6}$ cells were sorted and 5000 cells were collected. For subsequent sorts, at least $1\times10^{6}$ cells were sorted. The MACS2FACS3 (M2F3) population was sorted as described herein, but with the addition of 100 nM unlabeled isotype control antibody (BD Biosciences Cat#: 556657). The final MACS2FACS4 (M2F4) round of FACS selection was sorted as before but was labeled using unlabeled SP34 antibody labeled with an anti-mouse IgG-488 secondary 1:100 (Jackson ImmunoResearch Cat#: 315-486-045), resulting in the MACS2FACS5 (M2F5) population. The final M2F5 population was verified to specifically bind SP34 by demonstrating inhibition of 1 nM SP34-dylight-488 binding in the presence of 100 nM soluble human CD3ε protein (Sino Biologics Cat#: 10977-H08H). One hundred individual clones were chosen for sequence analysis, and 91 gave interpretable data. The results are summarized in Table 7.

TABLE 7

Selection #1 M2F5 sequences

| Peptide name | Peptide sequence (occurrence) |
|---|---|
| 14995 | YSLWGCEWGCDRGLY(73) (SEQ ID NO: 371) |
| 15003 | GYRWGCEWNCGGITT(8) (SEQ ID NO: 372) |
| 15253 | YSACEMFGEVECCFC(7) (SEQ ID NO: 373) |
| 15263 | WYSGGCEAFCGILSS(2) (SEQ ID NO: 374) |
| 15286 | GYSGGCEFRCYQLYS(1) (SEQ ID NO: 375) |

Selection #2

For all FACS selections, 50 μl of induced culture were spun down (5 min @ 3000×g) and labeled with the indicated concentration of antibody. The M2, M2F1, and M2F2 sorts, cells were labeled with 10 nM SP34-dylight-488 in 500 μL PBS, 0.5% BSA, 100 nM unlabeled isotype control antibody as described herein, and the top 10%, 38%, and 60% of binders were sorted, respectively. In each case, approximately $3\times10^6$ cells were sorted. Twenty individual clones were chosen for sequence analysis, and 19 gave interpretable data. The results are summarized in Table 8.

TABLE 8

Selection # 2 M2F2 sequences

| Sequence name | Peptide Sequence | |
|---|---|---|
| 15855 | KFCHCGYYCRVCTLK(1) | (SEQ ID NO: 376) |
| 15856 | LGCNNLWGNEFCHPV(1) | (SEQ ID NO: 377) |
| 15858 | GHPCWGNESYCHTHS(1) | (SEQ ID NO: 378) |
| 15859 | GNNKWCNKPCKCWNK(1) | (SEQ ID NO: 379) |
| 15860 | VYYCGGNESLCGERR(1) | (SEQ ID NO: 380) |
| 15861 | WMTFGCEFSCGTDEW(1) | (SEQ ID NO: 381) |
| 15862 | VYHWGCEYDCFFNDM(1) | (SEQ ID NO: 382) |
| 15863 | FSGCCRGWYNCCHRG(1) | (SEQ ID NO: 383) |
| 15864 | FMCQQRMWGNEFCHQ(1) | (SEQ ID NO: 384) |
| 15865 | MMYCGGNEVLCGPRV(1) | (SEQ ID NO: 385) |
| 15866 | TYSKCRYTVKCTKHN(1) | (SEQ ID NO: 386) |
| 15867 | WYSGGCEAFCGILSS(2) | (SEQ ID NO: 387) |
| 15868 | KYHCTRTSACCTKHH(1) | (SEQ ID NO: 388) |
| 15869 | NCFDPYMLLTYSCNS(1) | (SEQ ID NO: 389) |
| 15870 | GMCGNLWGDESRCWW(1) | (SEQ ID NO: 390) |
| 15857 | SCWDPYMMMNYICNI(3) | (SEQ ID NO: 391) |

On Cell Peptide Characterization

Eight peptides, 5 from the selection #1 M2F5 and 3 from the selection #2 M2F2 populations, were selected for further characterization on cell. The individual clones were labeled with 100, 10, 1, and 0.1 nM SP34-dylight-488 in the presence of 100 nM unlabeled isotype control antibody as described herein. Each clone was separately labeled with yPet-Mona to quantify the cell surface expression level of the peptides, allowing the calculation of expression normalized binding.

$$\text{Expression normalized binding} = \frac{\text{Mean } Fab \text{ fluorescence}}{\text{Mean } YpetMona \text{ fluorescence}}$$

And it's assumed that:

Mean YpetMona fluorescence=Peptide expression level

To verify the ability of the binding peptides to inhibit SP34's interaction with human CD3ε, each clone was labeled with 1 nM SP34-dylight-488 in the presence of 100 nM human CD3ε. The results are summarized in Table 9. All of the peptides evaluated specifically bound to SP34-dylight-488 and were inhibited from binding by excess free human CD3ε.

TABLE 9

Expression normalized binding of individual SP34 binding clones

| Label | 14995 | 15003 | 15253 | 15263 | 15286 | 15860 | 15864 | 15865 |
|---|---|---|---|---|---|---|---|---|
| 100 nM SP34 | 0.51 | 0.69 | 2.53 | 2.28 | 1.72 | 4.55 | 1.88 | 2.24 |
| 10 nM SP34 | 0.11 | 0.39 | 0.98 | 0.69 | 0.66 | 1.72 | 0.63 | 1.08 |
| 1 nM SP34 | 0.13 | 0.20 | 0.68 | 0.35 | 0.42 | 0.52 | 0.36 | 0.79 |
| 0.1 nM SP34 | 0.08 | 0.11 | 0.55 | 0.24 | 0.28 | 0.48 | 0.15 | 0.21 |
| 1 nM SP34 + 100 nM hCD3ε | 0.08 | 0.12 | 0.53 | 0.34 | 0.34 | 0.51 | 0.30 | 0.26 |

Example 2. Activatable Anti-CD3ε Antibodies

This Example describes the production of activatable anti-CD3ε antibodies of the disclosure.

Figure 4A:
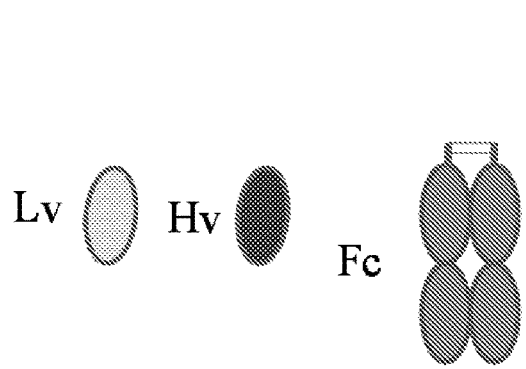
FIGS. 4A, 4B, and 4C are a series of illustrations depicting various antibodies and activatable antibodies of the disclosure.
Figure 4B:
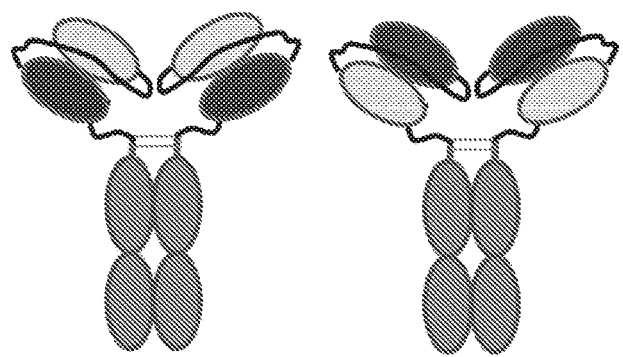
Figure 4C:
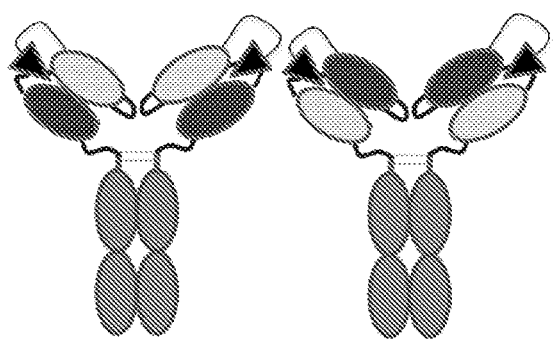
Figure 5A:
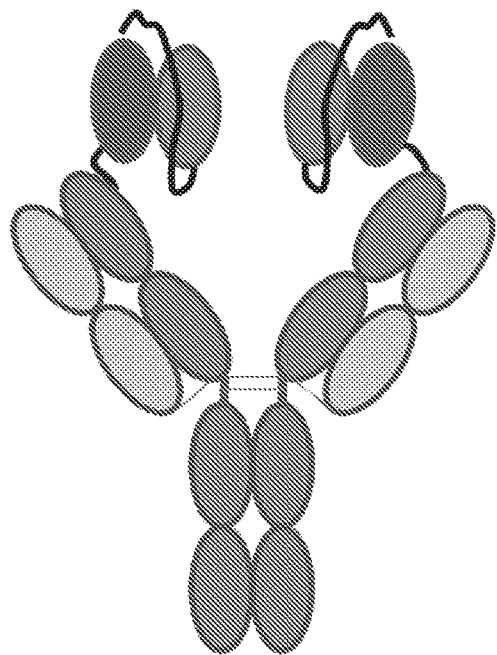
FIGS. 5A, 5B, 5C, and 5D are a series of illustrations depicting multispecific antibodies and multispecific activatable antibodies of the disclosure.
Figure 5B:
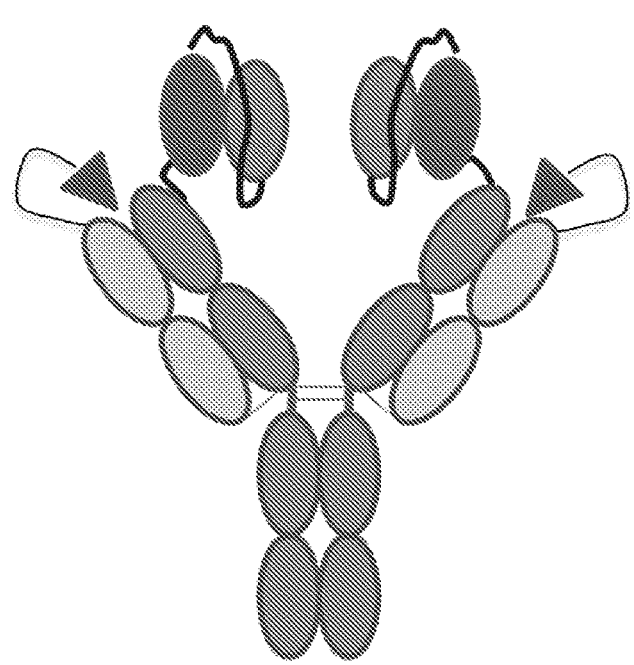
Figure 5C:
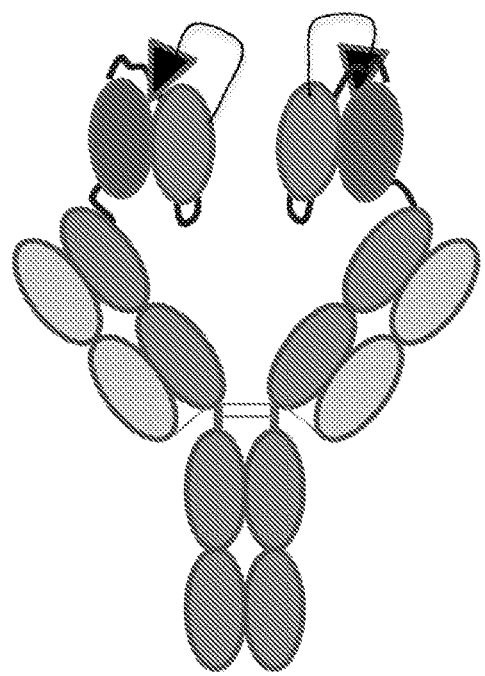
Figure 5D:
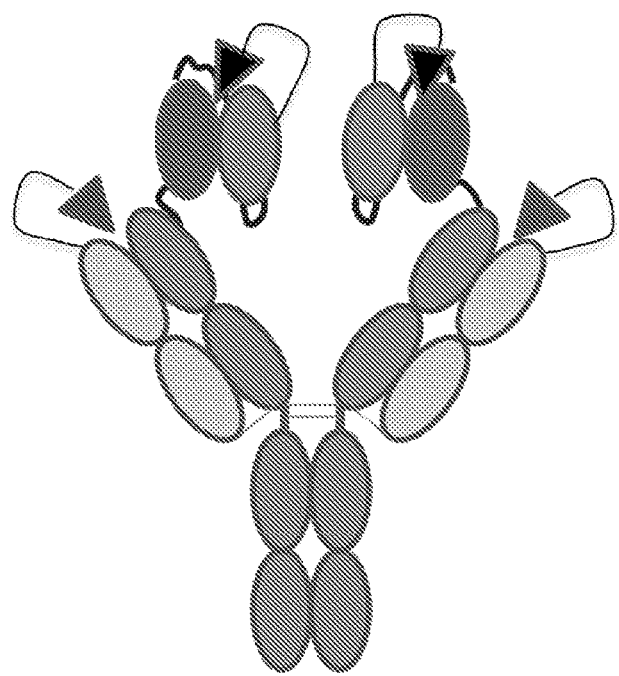
Figure 6A:
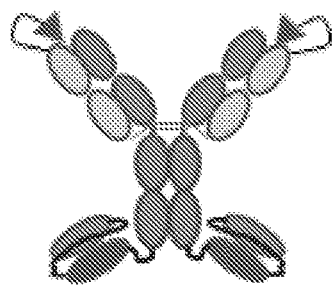
FIGS. 6A, 6B, 6C, 6D, 6E, and 6F are a series of illustrations depicting various embodiments of multispecific activatable antibodies of the disclosure.
Figure 6B:
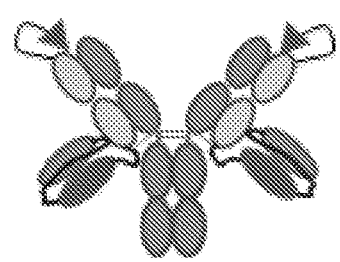
Figure 6C:
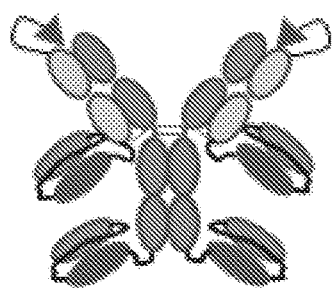
Figure 6D:
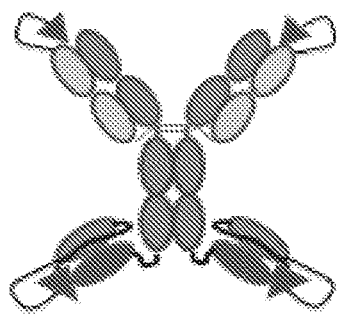
Figure 6E:
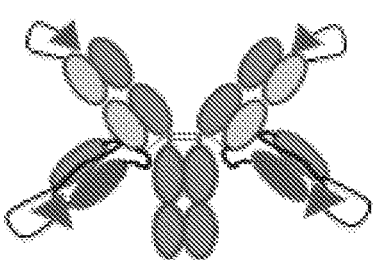
Figure 6F:
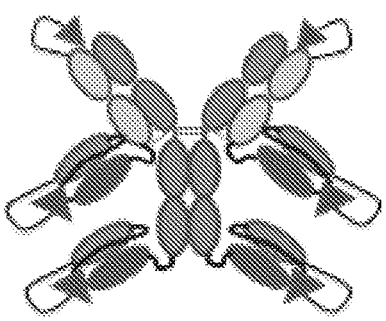
Figure 7A:
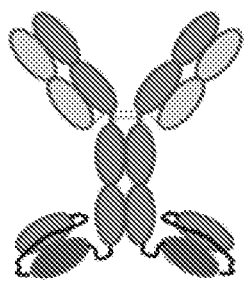
FIGS. 7A, 7B, 7C, 7D, 7E, 7F, 7G, 7H, 7I, and 7J are a series of schematic diagrams of a selected set of the possible permutations of multispecific antibodies of the disclosure.
Figure 7B:
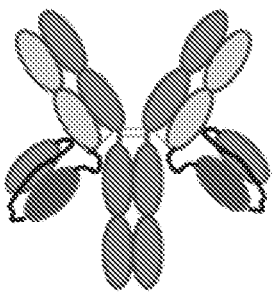
Figure 7C:
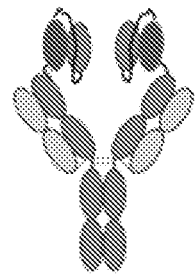
Figure 7D:
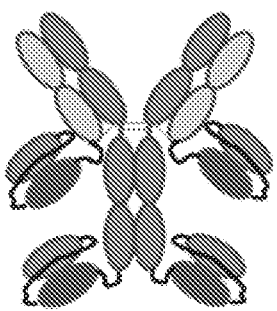
Figure 7E:
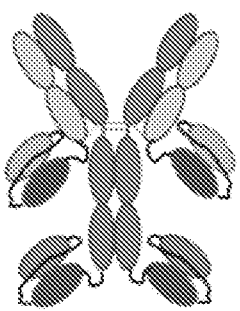
Figure 7F:
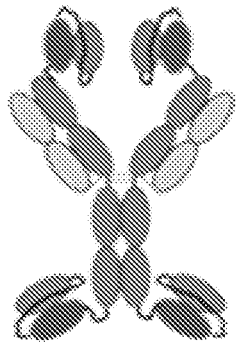
Figure 7G:
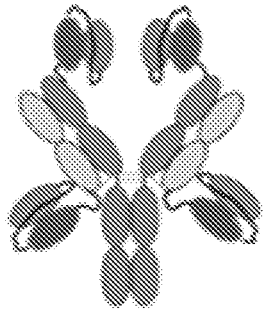
Figure 7H:
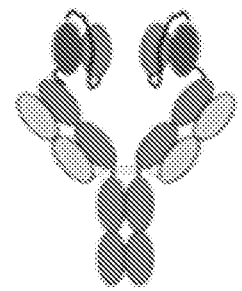
Figure 7I:
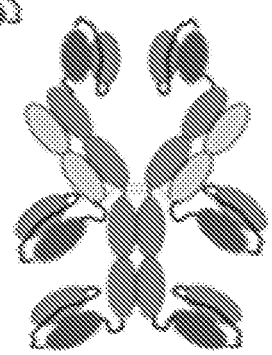
Figure 7J:
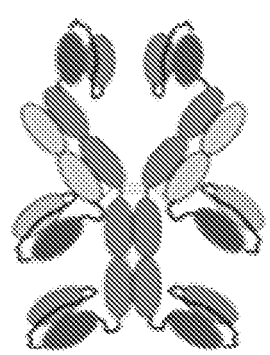
Figure 9A:
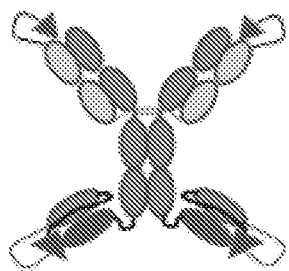
FIGS. 9A, 9B, 9C, 9D, 9E, 9F, 9G, 9H, and 9J are a series of schematic diagrams of an array of multispecific activatable antibodies in which all antigen-binding domains are masked.
Figure 9B:
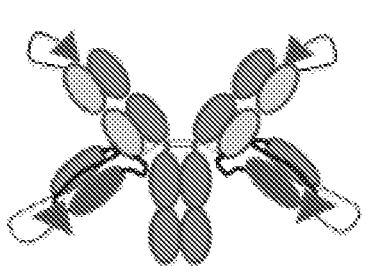
Figure 9C:
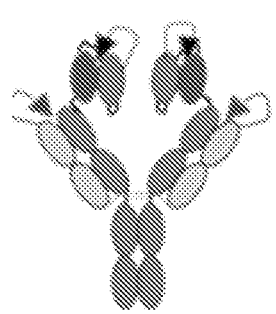
Figure 9D:
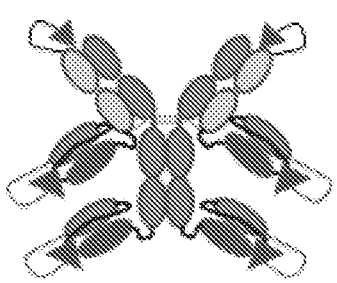
Figure 9E:
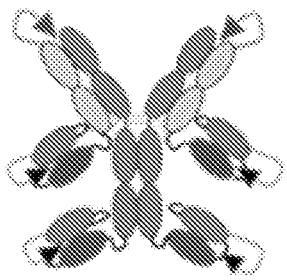
Figure 9F:
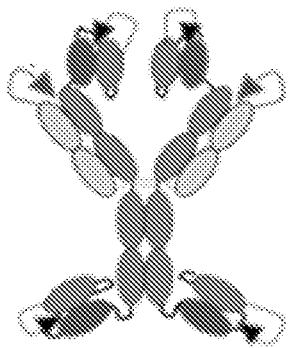
Figure 9G:
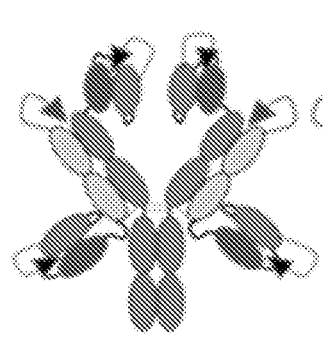
Figure 9H:
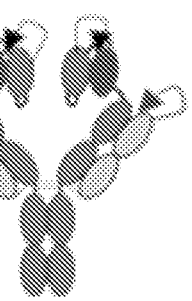
Figure 9I:
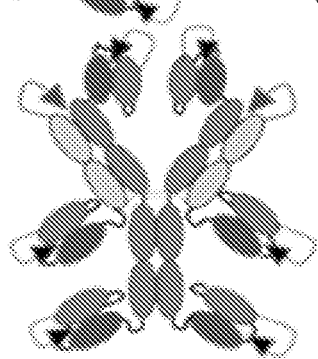
Figure 9J:
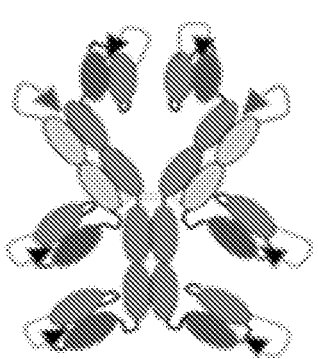
Figure 10A:
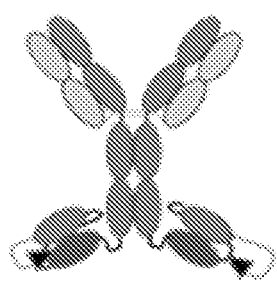
FIGS. 10A, 10B, 10C, 10D, 10E, 10F, 10G, 10H, 10I, and 10J are a series of schematic diagrams of an array of multispecific activatable antibodies in which the secondary antigen-binding domain is masked and the additional antigen-binding domain(s) is not masked.
Figure 10B:
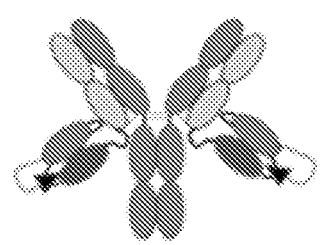
Figure 10C:
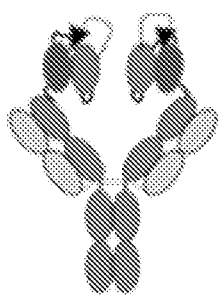
Figure 10D:
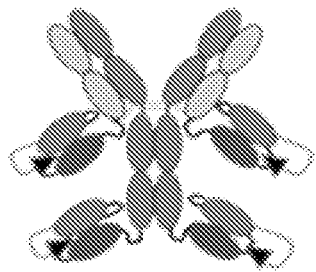
Figure 10E:
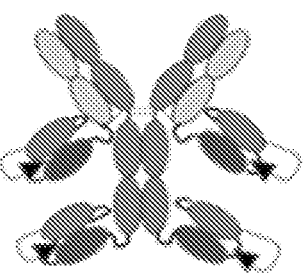
Figure 10F:
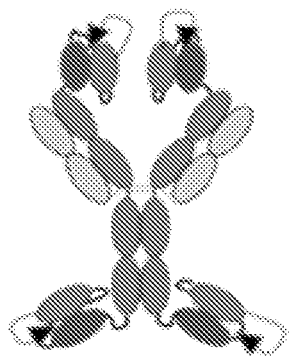
Figure 10G:
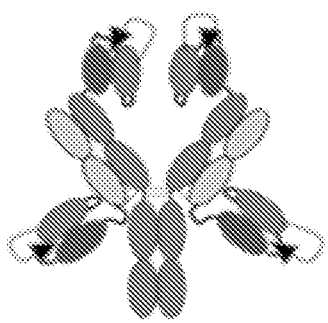
Figure 10H:
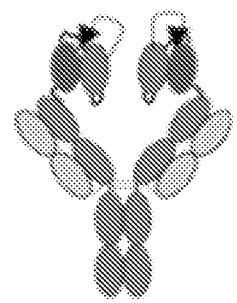
Figure 10I:
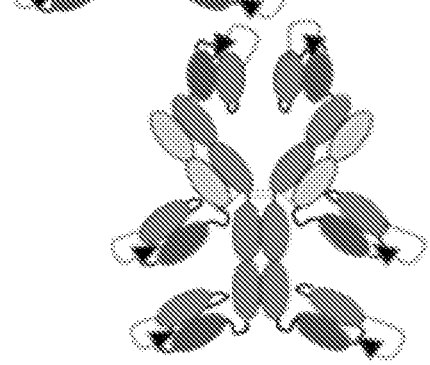
Figure 10J:
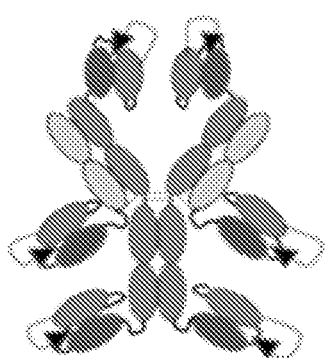

The expression vector for the SP34scFv(LvHv)-Fc fusion construct was assembled using standard molecular biology techniques. Briefly, a DNA fragment encoding the SP34 scFv (LvHv) region was amplified with primers CX2005 and CX2008 using a synthesized SP34scFv(LvHv) sequence as template. The DNA encoding the Fc domain was amplified from the pFIL-CHIg-hG1 vector (Invitrogen) using primers CX2007 and CX2006. The overlapping fragments were combined and amplified with primers CX2005 and CX2006 and subsequently cloned into the pOP Hyg expression vector (a modified pCDNA3.1 expression vector (Invitrogen)) using the EcoRI and NotI restriction sites to form antibody SP34scFv(LvHv)-Fc. A DNA fragment encoding antibody SP34scFv(HvLv)-Fc was produced in a similar manner with the following differences. The DNA fragment encoding the PSP34scFv(HvLv) was amplified using the primers CX2001 and CX200,4 and the DNA encoding the Fc domain was amplified using the primers CX2002 and CX2003. The overlapping fragments were combined and amplified using primers CX2001 and C2002. All primer sequences are shown in Table 10. Antibodies SP34scFv (LvHv)-Fc and SP34scFv(HvLv)-Fc were found to bind to Jurkat T cells with affinities similar to the ability of SP34 IgG to bind to Jurkat T cells. FIGS. 4A-4C depicts scFv (LvHv)-Fc and scFv(HvLv)-Fc antibodies and activatable antibodies of the disclosure.

Figure 2A:
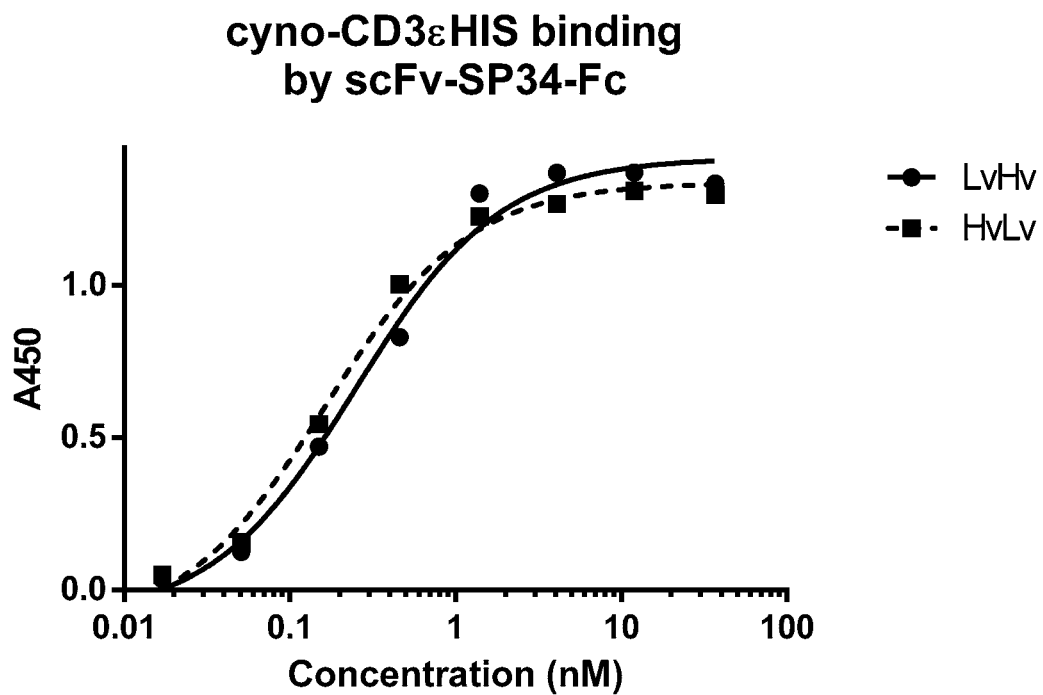
FIGS. 2A and 2B are a series of graphs depicting the ability of scFv formats of SP34 to bind to cynomolgus CD3ε.
Figure 2B:
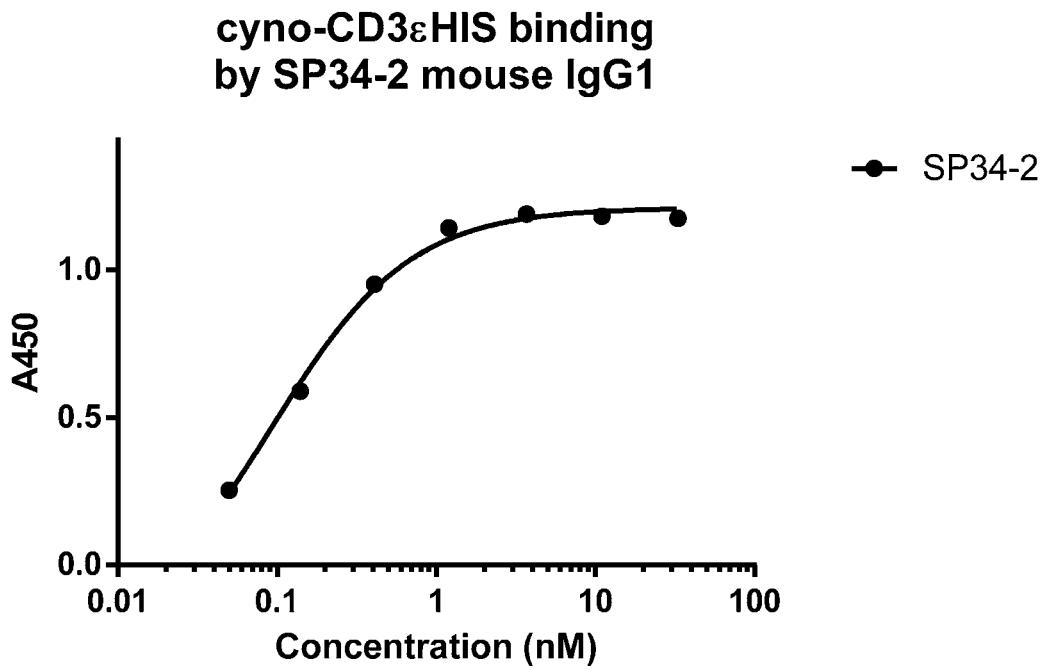
Figure 3B:
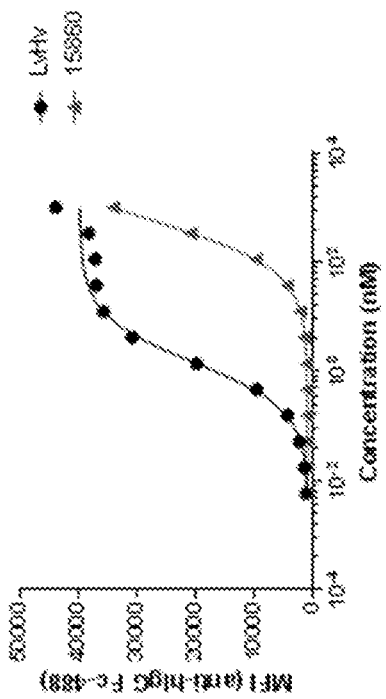
FIGS. 3A-3D are a series of graphs depicting the ability of masking moieties of the disclosure to reduce the ability of activatable anti-CD3ε antibodies comprising such masking moieties to bind to CD3ε on Jurkat T cells. Each activatable antibody is labeled by its masking moiety name. Antibody SP34scFv(LvHv)-Fc is identified by LvHv.
Figure 3D:
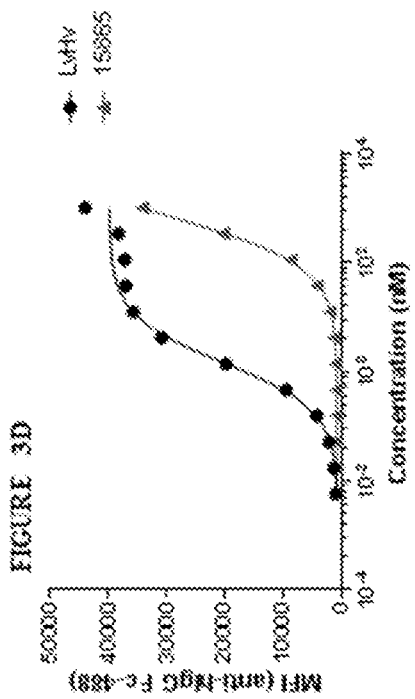
Figure 3A:
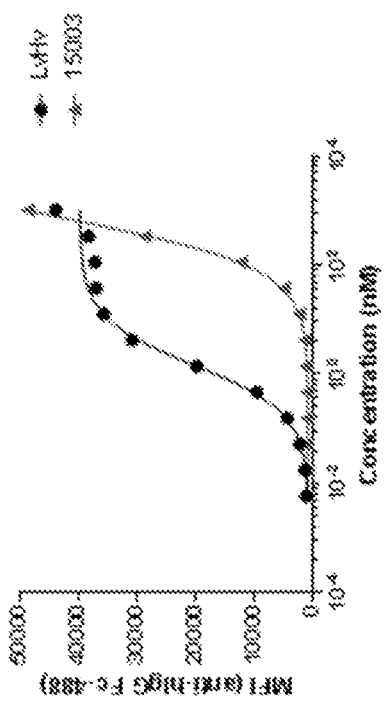
Figure 3C:
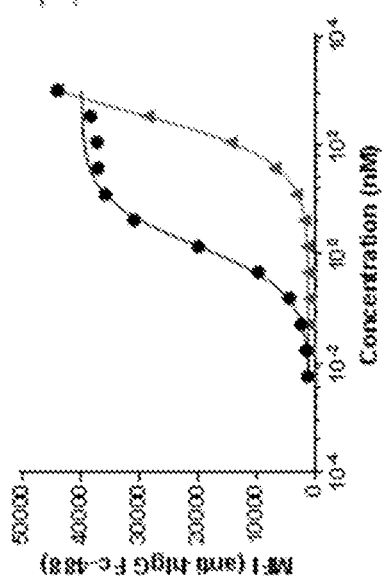

Antibodies SP34scFv(LvHv)-Fc and SP34scFv(HvLv)-Fc were also tested for their ability to bind to cynomolgus macaque (also referred to herein as cyno) CD3ε. To determine if antibodies SP34scFv(LvHv)-Fc and SP34scFv (HvLv)-Fc could bind to cynomolgus CD3ε, an ELISA-based binding assay was performed. Recombinant cynomolgus (*Macaca fascicularis*) CD3ε with a polyhistidine affinity tag at the C-terminus (Sino Biological, Catalog 90047-C08H) was coated in 50 μl PBS (PBS, Gibco Life Technologies, Catalog 20012-043) onto 96-well, flat bottom plates (Maxisorb Nunc, Thermo Scientific, Catalog 12-565-226) overnight at a concentration of 0.1 μg/ml at 4° C. The plates were washed 3 times with 250 μl/well PBS-T (Tween 20 at 0.05%), blocked with 200 μl PBS-T 2% BSA (BSA Fraction V, Fisher Scientific, product BP1600-1) for 1 hour at ambient temperature and washed 3 times with 250 μl/well PBS-T. Using 50 μl/well, either antibody SP34scFv(LvHv)-Fc or SP34scFv(HvLv)-Fc (purified to >95% monomer) was incubated in a concentration range from 37 nM to 0.017 nM diluted into PBS-T 2% BSA for 1 hour at ambient temperature. The plates were washed three times with 250 µl/well PBS-T, incubated with the secondary anti-human Fc-HRP 1/5000 dilution into PBS-T 2% BSA (Peroxidase AffiniPure Mouse Anti-Human IgG, Fcγ Fragment Specific, Jackson ImmunoResearch, Catalog 209-035-098) for 30 minutes at ambient temperature and washed 3 times with 250 µl/well PBS-T. HRP substrate (TMB-ELISA, Thermo Scientific, Product 34029) was added to the plate at 50 µl/well for 2 minutes and then quenched with 50 µl/well 1 M HCl before reading absorbance at 450 nM on the Tecan infinite 200Pro and analyzed with Prism 6 (GraphPad) by curve fitting the data to log(agonist) vs. response (three parameters). On a separate cyno CD3ε coated ELISA plate, SP34 mouse antibody (SP34-2, BD Biosciences, Catalog 551916) was coated and analyzed in the same manner and using the secondary anti-mouse IgG-HRP conjugate (Jackson ImmunoResearch, Catalog 715-035-150). FIGS. 2A and 2B demonstrate that scFv antibodies SP34scFv(LvHv)-Fc and SP34scFv(HvLv)-Fc as well as antibody SP34-2 bound to cynomolgus CD3εHIS within a similar range of $EC_{50}$ between 0.1 and 0.3 nM.

The vectors encoding activatable antibody SP34scFv (LvHv)-Fc were constructed as follows. The overlapping forward primers CX2013 and CX2014 and reverse primer CX2014 were used to amplify the activatable scFv antibody using the SP34scFv(LvHv)-Fc construct as template. The DNA fragment was then cloned into the SP34scFv(LvHv)-Fc vector using the EcoR1 and BstXI restriction sites. Using the SP34scFv(LvHv)-Fc fusion vector as template, the masking peptide sequences were added using the forward primers CX2041-CX2045 for peptides 15003, 15263, 15860, 15864, and 15865, respectively, and the reverse primer CX2002 and subsequently cloned using the SfiI and NotI restriction sites to produce nucleic acid molecules encoding activatable anti-CD3ε antibodies.

TABLE 10

Primer sequences

| PRIMER NAME | PRIMER SEQUENCE |
| --- | --- |
| CX2001 | ACTTGTCACGAATTCGGAAGTGCAGCTGGTGGAATCTGGGGCGGAC TGGTGCAGCCT (SEQ ID NO: 392) |
| CX2002 | TAGACTCGAGCGGCCGCTCATTTACCCGGAGACAGGGAGAGGCTCTT C (SEQ ID NO: 393) |
| CX2003 | TCGGCGGAGGCACCAAGCTGACCGTGCTGGGCGGCTCCCTGGACCCT AAGTCATCTGACAAAACTCACACATGCCCA (SEQ ID NO: 394) |
| CX2004 | TGGGCATGTGTGAGTTTTGTCAGATGACTTAGGGTCCAGGGAGCCGCC CAGCACGGTCAGCTTGGTGCCTCCGCCGA (SEQ ID NO: 395) |
| CX2005 | TGCACTTGTCACGAATTCGCAGGCTGTCGTGACACAGGAAAGCGCCCT GA (SEQ ID NO: 396) |
| CX2006 | TCTAGACTCGAGCGGCCGCTCATTTACCCGGAGACAGGGAGAGGCTC TTCT (SEQ ID NO: 397) |
| CX2007 | TGGGGCCAGGGCACCCTCGTGACAGTGTCTGCTGGCGGCTCCCTGGAC CCTAAGTCATCTGACAAAACTCACACATGCCCA (SEQ ID NO: 398) |
| CX2008 | TGGGCATGTGTGAGTTTTGTCAGATGACTTAGGGTCCAGGGAGCCGCC AGCAGACACTGTCACGAGGGTGCCCTGGCCCCA (SEQ ID NO: 399) |
| CX2012 | AGCGGTGGCTCTGGTGGTCTGAGCGGCCGTTCCGATAATCATGGCGGC GGTTCTCAGGCTGTCGTGACACAGGAAAGCGCCCTGACCACCA (SEQ ID NO: 400) |
| CX2013 | CTAAGTCTTGCACTTGTCACGAATTCGCAAGGCCAGTCTGGCCAAGGG TACCAAGGCTCGAGCGGTGGCAGCGGTGGCT (SEQ ID NO: 401) |
| CX2014 | TCCGGGCCACCCATTCCAGTCCCTTGCCAGGGGCCTGGCGCACCCAAT TCATGGCGTAGGTGTT (SEQ ID NO: 402) |
| CX2041 | CAAGGCCAGTCTGGCCAAGGTTATCGGTGGGGTTGCGAGTGGAATTG CGGTGGGATTACTACTGGCTCGAGCGGTGGCAGCGGTGGC (SEQ ID NO: 403) |
| CX2042 | CAAGGCCAGTCTGGCCAATGGTATTCGGTGGGTGCGAGGCTTTTTGC GGTATTTGTCGTCGGGCTCGAGCGGTGGCAGCGGTGGC (SEQ ID NO: 404) |
| CX2043 | CAAGGCCAGTCTGGCCAAGTTTATTATTGCGGTGGGAATGAGAGTCTG TGCGGTGAGAGGAGGGGCTCGAGCGGTGGCAGCGGTGGC (SEQ ID NO: 405) |
| CX2044 | CAAGGCCAGTCTGGCCAATTTATGTGCCAGCAGCGGATGTGGGGAA TGAGTTTTGCCATCAGGGCTCGAGCGGTGGCAGCGGTGGC (SEQ ID NO: 406) |

TABLE 10 -continued

Primer sequences

| PRIMER NAME | PRIMER SEQUENCE |
|---|---|
| CX2045 | CAAGGCCAGTCTGGCCAAATGATGTATTGCGGTGGGAATGAGGTGTT GTGCGGGCCGCGGGTTGGCTCGAGCGGTGGCAGCGGTGGC (SEQ ID NO: 370) |

SP34 Lv
Nucleotide sequence
(SEQ ID NO: 1)
CAGGCTGTCGTGACACAGGAAAGCGCCCTGACCACCAGCCCTGGCGAGACAGTGACCCTGACCTGCAGATCTAGCAC

AGGCGCCGTGACCACAAGCAACTACGCCAACTGGGTGCAGGAAAAGCCCGACCACCTGTTCACCGGCCTGATCGGCG

GCACCAACAAAAGGGCTCCAGGCGTGCCAGCCAGATTCAGCGGCAGCCTGATTGGCGATAAGGCCGCCCTGACAATC

ACTGGCGCCCAGACCGAGGACGAGGCCATCTACTTTTGCGCCCTGTGGTACAGCAACCTGTGGGTGTTCGGCGGAGG

CACCAAGCTGACAGTGCTG

Amino Acid sequence
(SEQ ID NO: 2)
QAVVTQESALTTSPGETVTLTCRSSTGAVTTSNYANWVQEKPDHLFTGLIGGTNKRAPGVPARFSGSLIGDKAALTI

TGAQTEDEAIYFCALWYSNLWVFGGGTKLTVL

SP34 Hv
Nucleotide sequence
(SEQ ID NO: 3)
GAAGTGCAGCTGGTGGAATCTGGCGGCGGACTGGTGCAGCCTAAGGGCTCTCTGAAGCTGAGCTGTGCCGCCAGCGG

CTTCACCTTCAACACCTACGCCATGAATTGGGTGCGCCAGGCCCCTGGCAAGGGACTGGAATGGGTGGCCCGGATCA

GAAGCAAGTACAACAATTACGCCACCTACTACGCCGACAGCGTGAAGGACCGGTTCACCATCAGCCGGGACGACAGC

CAGAGCATCCTGTATCTGCAGATGAACAACCTGAAAACCGAGGACACCGCCATGTACTACTGCGTGCGGCACGGCAA

CTTCGGCAACAGCTATGTGTCTTGGTTTGCCTACTGGGGCCAGGGCACCCTCGTGACAGTGTCTGCT

Amino Acid sequence
(SEQ ID NO: 4)
EVQLVESGGGLVQPKGSLKLSCAASGFTFNTYAMNWVRQAPGKGLEWVARIRSKYNNYATYYADSVKDRFTISRDDS

QSILYLQMNNLKTEDTAMYYCVRHGNFGNSYVSWFAYWGQGTLVTVSA

SP34scFv(LvHv)
Nucleotide sequence
(SEQ ID NO: 5)
CAGGCTGTCGTGACACAGGAAAGCGCCCTGACCACCAGCCCTGGCGAGACAGTGACCCTGACCTGCAGATCTAGCAC

AGGCGCCGTGACCACAAGCAACTACGCCAACTGGGTGCAGGAAAAGCCCGACCACCTGTTCACCGGCCTGATCGGCG

GCACCAACAAAAGGGCTCCAGGCGTGCCAGCCAGATTCAGCGGCAGCCTGATTGGCGATAAGGCCGCCCTGACAATC

ACTGGCGCCCAGACCGAGGACGAGGCCATCTACTTTTGCGCCCTGTGGTACAGCAACCTGTGGGTGTTCGGCGGAGG

CACCAAGCTGACAGTGCTGGGAGGCGGAGGATCTGGCGGAGGCGGAAGTGGCGGAGGGGGATCTGAAGTGCAGCTGG

TGGAATCTGGCGGCGGACTGGTGCAGCCTAAGGGCTCTCTGAAGCTGAGCTGTGCCGCCAGCGGCTTCACCTTCAAC

ACCTACGCCATGAATTGGGTGCGCCAGGCCCCTGGCAAGGGACTGGAATGGGTGGCCCGGATCAGAAGCAAGTACAA

CAATTACGCCACCTACTACGCCGACAGCGTGAAGGACCGGTTCACCATCAGCCGGGACGACAGCCAGAGCATCCTGT

ATCTGCAGATGAACAACCTGAAAACCGAGGACACCGCCATGTACTACTGCGTGCGGCACGGCAACTTCGGCAACAGC

TATGTGTCTTGGTTTGCCTACTGGGGCCAGGGCACCCTCGTGACAGTGTCTGCT

Amino Acid sequence
(SEQ ID NO: 6)
QAVVTQESALTTSPGETVTLTCRSSTGAVTTSNYANWVQEKPDHLFTGLIGGTNKRAPGVPARFSGSLIGDKAALTI

TGAQTEDEAIYFCALWYSNLWVFGGGTKLTVLGGGGSGGGGSGGGGSEVQLVESGGGLVQPKGSLKLSCAASGFTFN

-continued

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSA

Antibody SP34scFv(LvHv)-Fc fusion
Nucleotide sequence
(SEQ ID NO: 7)
CAGGCTGTCGTGACACAGGAAAGCGCCCTGACCACCAGCCCTGGCGAGACAGTGACCCTGACCTGCAGATCTAGCAC

AGGCGCCGTGACCACAAGCAACTACGCCAACTGGGTGCAGGAAAAGCCCGACCACCTGTTCACCGGCCTGATCGGCG

GCACCAACAAAAGGGCTCCAGGCGTGCCAGCCAGATTCAGCGGCAGCCTGATTGGCGATAAGGCCGCCCTGACAATC

ACTGGCGCCCAGACCGAGGACGAGGCCATCTACTTTTGCGCCCTGTGGTACAGCAACCTGTGGGTGTTCGGCGGAGG

CACCAAGCTGACAGTGCTGGGAGGCGGAGGATCTGGCGGAGGCGGAAGTGGCGGAGGGGGATCTGAAGTGCAGCTGG

TGGAATCTGGCGGCGGACTGGTGCAGCCTAAGGGCTCTCTGAAGCTGAGCTGTGCCGCCAGCGGCTTCACCTTCAAC

ACCTACGCCATGAATTGGGTGCGCCAGGCCCCTGGCAAGGGACTGGAATGGGTGGCCCGGATCAGAAGCAAGTACAA

CAATTACGCCACCTACTACGCCGACAGCGTGAAGGACCGGTTCACCATCAGCCGGGACGACAGCCAGAGCATCCTGT

ATCTGCAGATGAACAACCTGAAAACCGAGGACACCGCCATGTACTACTGCGTGCGGCACGGCAACTTCGGCAACAGC

TATGTGTCTTGGTTTGCCTACTGGGGCCAGGGCACCCTCGTGACAGTGTCTGCTGGCGGCTCCCTGGACCCTAAGTC

ATCTGACAAAACTCACACATGCCCACCGTGCCCAGCACCTGAACTCCTGGGGGGACCGTCAGTCTTCCTCTTCCCCC

CAAAACCCAAGGACACCCTCATGATCTCCCGGACCCCTGAGGTCACATGCGTGGTGGTGGACGTGAGCCACGAAGAC

CCTGAGGTCAAGTTCAACTGGTACGTGGACGGCGTGGAGGTGCATAATGCCAAGACAAAGCCGCGGGAGGAGCAGTA

CAACAGCACGTACCGTGTGGTCAGCGTCCTCACCGTCCTGCACCAGGACTGGCTGAATGGCAAGGAGTACAAGTGCA

AGGTCTCCAACAAAGCCCTCCCAGCCCCCATCGAGAAAACCATCTCCAAAGCCAAAGGGCAGCCCCGAGAACCACAG

GTGTACACCCTGCCCCCATCCCGGGAGGAGATGACCAAGAACCAGGTCAGCCTGACCTGCCTGGTCAAAGGCTTCTA

TCCCAGCGACATCGCCGTGGAGTGGGAGAGCAATGGGCAGCCGGAGAACAACTACAAGACCACGCCTCCCGTGCTGG

ACTCCGACGGCTCCTTCTTCCTCTACAGCAAGCTCACCGTGGACAAGAGCAGGTGGCAGCAGGGGAACGTCTTCTCA

TGCTCCGTGATGCATGAGGCTCTGCACAACCACTACACGCAGAAGAGCCTCTCCCTGTCTCCGGGTAAA

Amino Acid sequence
(SEQ ID NO: 8)
QAVVTQESALTTSPGETVTLTCRSSTGAVTTSNYANWVQEKPDHLFTGLIGGTNKRAPGVPARFSGSLIGDKAALTI

TGAQTEDEAIYFCALWYSNLWVFGGGTKLTVLGGGGSGGGGSGGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGSLDPKSSDKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQQGNVFS

CSVMHEALHNHYTQKSLSLSPGK 15003-1204-SP34scFv(LvHv)
Nucleotide sequence
[spacer (SEQ ID NO: 507)][Antibody 15003-1204-SP34scFv(LvHv)without spacer
(SEQ ID NO: 547)]
(SEQ ID NO: 9)
[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

-continued

```
GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCT]
```

Amino Acid sequence
[spacer (SEQ ID NO: 87)][Antibody 15003-1204-SP34scFv(LvHv)without spacer
(SEQ ID NO: 548)]

(SEQ ID NO: 10)

[QGQSGQ][GYRWGCEWNCGGITTGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSA]

Activatable antibody 15003-1204-SP34scFv(LvHv)-Fc fusion
Nucleotide sequence
[spacer (SEQ ID NO: 507)][Activatable Antibody 15003-1204-SP34scFv(LvHv)-Fc
fusion without spacer (SEQ ID NO: 549)]

(SEQ ID NO: 11)

```
[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCTGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]
```

Amino Acid Sequence
[spacer (SEQ ID NO: 407)][Activatable Antibody 15003-1204-SP34scFv(LvHv)-Fc
fusion without spacer (SEQ ID NO: 550)]

(SEQ ID NO: 12)

[QGQSGQ][GYRWGCEWNCGGITTGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSAGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15263-1204-SP34scFv(LvHv)
Nucleotide sequence
[spacer (SEQ ID NO: 507)][15263-1204-SP34scFv(LvHv) without spacer
(SEQ ID NO: 551)]

(SEQ ID NO: 13)

[CAAGGCCAGTCTGGCCAA][TGGTATTCGGGTGGGTGCGAGGCTTTTTGCGGTATTTTGTCGTCGGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCT]

Amino Acid sequence
[spacer (SEQ ID NO: 87)][15263-1204-SP34scFv(LvHv)without spacer
(SEQ ID NO: 552)]

(SEQ ID NO: 14)

[QGQSGQ][WYSGGCEAFCGILSSGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSA]

Activatableantibody15263-1204-SP34scFv(LyHy)-Fcfusion
Nucleotide sequence
[spacer (SEQ ID NO: 507)][Activatable antibody 15263-1204-SP34scFv(LvHv)-Fc
fusion without spacer (SEQ ID NO: 553)]

(SEQ ID NO: 15)

[CAAGGCCAGTCTGGCCAA][TGGTATTCGGGTGGGTGCGAGGCTTTTTGCGGTATTTTGTCGTCGGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCTGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

-continued

```
GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]
```

Amino acid sequence
[spacer (SEQ ID NO: 87)][Activatable antibody 15263-1204-SP34scFv(LvHv)-Fc
fusion without spacer (SEQ ID NO: 554)]]
(SEQ ID NO: 16)
[QGQSGQ][WYSGGCEAFCGILSSGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSAGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15860-1204-SP34scFv(LvHv)
Nucleotide sequence
[spacer (SEQ ID NO: 507)][15860-1204-SP34scFv(LvHv) without spacer
(SEQ ID NO: 555)]
(SEQ ID NO: 17)

```
[CAAGGCCAGTCTGGCCAA][GTTTATTATTGCGGTGGGAATGAGAGTCTGTGCGGTGAGAGGAGGGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCT]
```

Amino Acid sequence
[spacer (SEQ ID NO: 87)][15263-1204-SP34scFv(LvHv)without spacer
(SEQ ID NO: 556)]
(SEQ ID NO: 18)
[QGQSGQ][VYYCGGNESLCGERRGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSA]

Activatable antibody 15860-1204-SP34scFv(LvHv)-Fc fusion
Nucleotide sequence
[spacer (SEQ ID NO: 507)][Activatable antibody 15860-1204-SP34scFv(LvHv)-Fc
fusion without spacer (SEQ ID NO: 557)]
(SEQ ID NO: 19)

```
[CAAGGCCAGTCTGGCCAA][GTTTATTATTGCGGTGGGAATGAGAGTCTGTGCGGTGAGAGGAGGGGCTCGAGCGG

TGGCAGCGGTGGCTCTGGTGGTCTGAGCGGCCGTTCCGATAATCATGGCGGCGGTTCTCAGGCTGTCGTGACACAGG
```

-continued

```
AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCTGGCGGCTCCCTGGACCCTAAGTCATCTGACAAAACTCACACA

TGCCCACCGTGCCCAGCACCTGAACTCCTGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]

Amino Acid sequence
[spacer (SEQ ID NO: 87)][Activatable antibody 15860-1204-SP34scFv(LvHv)-Fc
fusion without spacer (SEQ ID NO: 558)]
                                                          (SEQ ID NO: 20)
[QGQSGQ][VYYCGGNESLCGERRGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQTLVTVSAGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15864-1204-SP34scFv(LvHv)
Nucleotide sequence
[spacer (SEQ ID NO: 507)][15864-1204-SP34scFv(LvHv) without spacer (SEQ ID
NO: 559)]
                                                          (SEQ ID NO: 21)
[CAAGGCCAGTCTGGCCAA][TTTATGTGCCAGCAGCGGATGTGGGGAATGAGTTTTGCCATCAGGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT
```

-continued

```
GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCT]
```

Amino Acid
[spacer (SEQ ID NO: 87)][15864-1204-SP34scFv(LvHv) without spacer (SEQ ID
NO: 560)]

(SEQ ID NO: 22)
[QGQSGQ][FMCQQRMWGNEFCHQGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSA]

Activatab le antibody 15864-1204-SP34scFv(Lvtiv)-Fc fusion
Nucleotide sequence
[spacer (SEQ ID NO: 507)][Activatable antibody 15864-1204-SP34scFv(LvHv)-Fc
fusion without spacer (SEQ ID NO: 561)]

(SEQ ID NO: 23)
```
[CAAGGCCAGTCTGGCCAA][TTTATGTGCCAGCAGCGGATGTGGGGGAATGAGTTTTGCCATCAGGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCTGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]
```

Amino acid sequence
[spacer (SEQ ID NO: 87)][Activatable antibody 15864-1204-SP34scFv(LvHv)-Fc
fusion without spacer (SEQ ID NO: 562)]

(SEQ ID NO: 24)
[QGQSGQ][FMCQQRMWGNEFCHQGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSAGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

-continued 15865-1204-SP34scFv(LvHv)
Nucleotide sequence
[spacer (SEQ ID NO: 507)][15865-1204-SP34scFv(LvHv) without spacer (SEQ ID
NO: 563)]

(SEQ ID NO: 25)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCT]

Amino Acid sequence
[spacer (SEQ ID NO: 87)][15865-1204-SP34scFv(LvHv) without spacer (SEQ ID
NO: 564)]

(SEQ ID NO: 26)
[QGQSGQ][MMYCGGNEVLCGPRVGSSGGSGGSGGLSGRSDNHGGGSQAVVTQESALTTSPGETVTLTCRSSTGAVT

TSNYANWVQEKPDHLFTGLIGGTNKRAPGVPARFSGSLIGDKAALTITGAQTEDEAIYFCALWYSNLWVFGGGTKLT

VLGGGGSGGGGSGGGGSEVQLVESGGGLVQPKGSLKLSCAASGFTFNTYAMNWVRQAPGKGLEWVARIRSKYNNYAT

YYADSVKDRFTISRDDSQSILYLQMNNLKTEDTAMYYCVRHGNFGNSYVSWFAYWGQGTLVTVSA]

Activatable antibody 15865-1204-SP34scFv(LvHv)-Fc fusion
Nucleotide sequence
[spacer (SEQ ID NO: 507)][Activatable antibody 15865-1204-SP34scFv(LvHv)-Fc
fusion without spacer (SEQ ID NO: 565)]

(SEQ ID NO: 27)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGGCTGTCGTGACACAGG

AAAGCGCCCTGACCACCAGCCCTGGCGAGACAGTGACCCTGACCTGCAGATCTAGCACAGGCGCCGTGACCACAAGC

AACTACGCCAACTGGGTGCAGGAAAAGCCCGACCACCTGTTCACCGGCCTGATCGGCGGCACCAACAAAGGGCTCC

AGGCGTGCCAGCCAGATTCAGCGGCAGCCTGATTGGCGATAAGGCCGCCCTGACAATCACTGGCGCCCAGACCGAGG

ACGAGGCCATCTACTTTTGCGCCCTGTGGTACAGCAACCTGTGGGTGTTCGGCGGAGGCACCAAGCTGACAGTGCTG

GGAGGCGGAGGATCTGGCGGAGGCGGAAGTGGCGGAGGGGGATCTGAAGTGCAGCTGGTGGAATCTGGCGGCGGACT

GGTGCAGCCTAAGGGCTCTCTGAAGCTGAGCTGTGCCGCCAGCGGCTTCACCTTCAACACCTACGCCATGAATTGGG

TGCGCCAGGCCCCTGGCAAGGGACTGGAATGGGTGGCCCGGATCAGAAGCAAGTACAACAATTACGCCACCTACTAC

GCCGACAGCGTGAAGGACCGGTTCACCATCAGCCGGGACGACAGCCAGAGCATCCTGTATCTGCAGATGAACAACCT

GAAAACCGAGGACACCGCCATGTACTACTGCGTGCGGCACGGCAACTTCGGCAACAGCTATGTGTCTTGGTTTGCCT

ACTGGGGCCAGGGCACCCTCGTGACAGTGTCTGCTGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

-continued

```
GAGTGGGAGAGCAATGGGCAGCCGGAGAACAACTACAAGACCACGCCTCCCGTGCTGGACTCCGACGGCTCCTTCTT
CCTCTACAGCAAGCTCACCGTGGACAAGAGCAGGTGGCAGCAGGGGAACGTCTTCTCATGCTCCGTGATGCATGAGG
CTCTGCACAACCACTACACGCAGAAGAGCCTCTCCCTGTCTCCGGGTAAA]
```

Amino Acid sequence
[spacer (SEQ ID NO: 87)][Activatable antibody 15865-1204-SP34scFv(LvHv)-Fc
fusion without spacer (SEQ ID NO: 566)]
(SEQ ID NO: 28)

```
[QGQSGQ][MMYCGGNEVLCGPRVGSSGGSGGSGGLSGRSDNHGGGSQAVVTQESALTTSPGETVTLTCRSSTGAVT
TSNYANWVQEKPDHLFTGLIGGTNKRAPGVPARFSGSLIGDKAALTITGAQTEDEAIYFCALWYSNLWVFGGGTKLT
VLGGGGSGGGGSGGGGSEVQLVESGGGLVQPKGSLKLSCAASGFTFNTYAMNWVRQAPGKGLEWVARIRSKYNNYAT
YYADSVKDRFTISRDDSQSILYLQMNNLKTEDTAMYYCVRHGNFGNSYVSWFAYWGQGTLVTVSAGGSLDPKSSDKT
HTCPPCPAPELLGGPSVFLFPPKPKDTLMISRTPEVTCVVVDVSHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQKSLSLSPGK]
```

SP34scFv(HvLv)
Nucleotide sequence
(SEQ ID NO: 29)

```
GAAGTGCAGCTGGTGGAATCTGGGGGCGGACTGGTGCAGCCTAAGGGCAGCCTGAAGCTGAGCTGTGCCGCCAGCGG
CTTCACCTTCAACACCTACGCCATGAACTGGGTGCGCCAGGCCCCTGGCAAAGGCCTGGAATGGGTGGCCCGGATCA
GAAGCAAGTACAACAATTACGCCACCTACTACGCCGACAGCGTGAAGGACAGATTCACCATCAGCCGGGACGACAGC
CAGAGCATCCTGTACCTGCAGATGAACAACCTGAAAACCGAGGACACCGCCATGTACTACTGCGTGCGGCACGGCAA
CTTCGGCAACAGCTATGTGTCTTGGTTTGCCTACTGGGGCCAGGGCACCCTCGTGACAGTGTCTGCCGGTGGTGGTG
GTAGTGGTGGCGGTGGTTCAGGCGGTGGCGGTAGCCAGGCTGTCGTGACACAGGAAAGCGCCCTGACCACCAGCCCT
GGCGAGACAGTGACCCTGACCTGTAGAAGCAGCACAGGCGCCGTGACCACAAGCAACTACGCCAATTGGGTGCAGGA
AAAGCCCGACCACCTGTTCACCGGCCTGATCGGCGGCACCAACAAAAGGGCTCCAGGCGTGCCAGCCAGATTCAGCG
GCTCCCTGATCGGAGATAAGGCCGCCCTGACAATCACTGGCGCCCAGACCGAGGACGAGGCCATCTACTTTTGCGCC
CTGTGGTACAGCAACCTGTGGGTGTTCGGCGGAGGCACCAAGCTGACCGTGCTG
```

Amino Acid sequence
(SEQ ID NO: 30)

```
EVQLVESGGGLVQPKGSLKLSCAASGFTFNTYAMNWVRQAPGKGLEWVARIRSKYNNYATYYADSVKDRFTISRDDS
QSILYLQMNNLKTEDTAMYYCVRHGNFGNSYVSWFAYWGQGTLVTVSAGGGGSGGGGSGGGGSQAVVTQESALTTSP
GETVTLTCRSSTGAVTTSNYANWVQEKPDHLFTGLIGGTNKRAPGVPARFSGSLIGDKAALTITGAQTEDEAIYFCA
LWYSNLWVFGGGTKLTVL
```

Antibody SP34scFv(HvLv)-Fc fusion
Nucleotide sequence
(SEQ ID NO: 31)

```
GAAGTGCAGCTGGTGGAATCTGGGGGCGGACTGGTGCAGCCTAAGGGCAGCCTGAAGCTGAGCTGTGCCGCCAGCGG
CTTCACCTTCAACACCTACGCCATGAACTGGGTGCGCCAGGCCCCTGGCAAAGGCCTGGAATGGGTGGCCCGGATCA
GAAGCAAGTACAACAATTACGCCACCTACTACGCCGACAGCGTGAAGGACAGATTCACCATCAGCCGGGACGACAGC
CAGAGCATCCTGTACCTGCAGATGAACAACCTGAAAACCGAGGACACCGCCATGTACTACTGCGTGCGGCACGGCAA
CTTCGGCAACAGCTATGTGTCTTGGTTTGCCTACTGGGGCCAGGGCACCCTCGTGACAGTGTCTGCCGGTGGTGGTG
GTAGTGGTGGCGGTGGTTCAGGCGGTGGCGGTAGCCAGGCTGTCGTGACACAGGAAAGCGCCCTGACCACCAGCCCT
GGCGAGACAGTGACCCTGACCTGTAGAAGCAGCACAGGCGCCGTGACCACAAGCAACTACGCCAATTGGGTGCAGGA
AAAGCCCGACCACCTGTTCACCGGCCTGATCGGCGGCACCAACAAAAGGGCTCCAGGCGTGCCAGCCAGATTCAGCG
GCTCCCTGATCGGAGATAAGGCCGCCCTGACAATCACTGGCGCCCAGACCGAGGACGAGGCCATCTACTTTTGCGCC
CTGTGGTACAGCAACCTGTGGGTGTTCGGCGGAGGCACCAAGCTGACCGTGCTGGGCGGCTCCCTGGACCCTAAGTC
```

-continued
```
ATCTGACAAAACTCACACATGCCCACCGTGCCCAGCACCTGAACTCCTGGGGGGACCGTCAGTCTTCCTCTTCCCCC

CAAAACCCAAGGACACCCTCATGATCTCCCGGACCCCTGAGGTCACATGCGTGGTGGTGGACGTGAGCCACGAAGAC

CCTGAGGTCAAGTTCAACTGGTACGTGGACGGCGTGGAGGTGCATAATGCCAAGACAAAGCCGCGGGAGGAGCAGTA

CAACAGCACGTACCGTGTGGTCAGCGTCCTCACCGTCCTGCACCAGGACTGGCTGAATGGCAAGGAGTACAAGTGCA

AGGTCTCCAACAAAGCCCTCCCAGCCCCCATCGAGAAAACCATCTCCAAAGCCAAAGGGCAGCCCCGAGAACCACAG

GTGTACACCCTGCCCCCATCCCGGGAGGAGATGACCAAGAACCAGGTCAGCCTGACCTGCCTGGTCAAAGGCTTCTA

TCCCAGCGACATCGCCGTGGAGTGGGAGAGCAATGGGCAGCCGGAGAACAACTACAAGACCACGCCTCCCGTGCTGG

ACTCCGACGGCTCCTTCTTCCTCTACAGCAAGCTCACCGTGGACAAGAGCAGGTGGCAGCAGGGGAACGTCTTCTCA

TGCTCCGTGATGCATGAGGCTCTGCACAACCACTACACGCAGAAGAGCCTCTCCCTGTCTCCGGGTAAA
```

Amino Acid sequence (SEQ ID NO: 32)

EVQLVESGGGLVQPKGSLKLSCAASGFTFNTYAMNWVRQAPGKGLEWVARIRSKYNNYATYYADSVKDRFTISRDDS

QSILYLQMNNLKTEDTAMYYCVRHGNFGNSYVSWFAYWGQGTLVTVSAGGGGSGGGGSGGGGSQAVVTQESALTTSP

GETVTLTCRSSTGAVTTSNYANWVQEKPDHLFTGLIGGTNKRAPGVPARFSGSLIGDKAALTITGAQTEDEAIYFCA

LWYSNLWVFGGGTKLTVLGGSLDPKSSDKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQQGNVFS

CSVMHEALHNHYTQKSLSLSPGK 15003-1204-SP34scFv(HvLv)
Nucleotide sequence
[spacer (SEQ ID NO: 507)][15003-1204-SP34scFv(HvLv) without spacer (SEQ ID
NO: 567)]

(SEQ ID NO: 33)
```
[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTG
```

Amino Acid sequence
[spacer (SEQ ID NO: 87)][15003-1204-SP34scFv(HvLv)without spacer (SEQ ID
NO: 568)]

(SEQ ID NO: 34)
[QGQSGQ][GYRWGCEWNCGGITTGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVL]

-continued

```
Activatable antibody 15003-1204-SP34scFv(HvLv)-Fc fusion
Nucleotide sequence
[spacer (SEQ ID NO: 507)][Activatable antibody 15003-1204-SP34scFv(HvLv)-Fc
fusion without spacer (SEQ ID NO: 569)]
                                                                 (SEQ ID NO: 35)
[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTGGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA

Amino Acid sequence
[spacer (SEQ ID NO: 87)][Activatable antibody 15003-1204-SP34scFv(HvLv)-Fc
fusion without spacer (SEQ ID NO: 570)]
                                                                 (SEQ ID NO: 36)
[QGQSGQ][GYRWGCEWNCGGITTGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVLGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15263-1204-SP34scFv(HvLv)
Nucleotide sequence
[spacer (SEQ ID NO: 507)][15263-1204-SP34scFv(HvLv) without spacer (SEQ ID
NO: 571)]
                                                                 (SEQ ID NO: 37)
[CAAGGCCAGTCTGGCCAA][TGGTATTCGGGTGGGTGCGAGGCTTTTTGCGGTATTTTGTCGTCGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC
```

-continued

```
AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTG]
```

Amino Acid sequence
[spacer (SEQ ID NO: 87)][15263-1204-SP34scFv(HvLv) without spacer (SEQ ID NO: 572)]

(SEQ ID NO: 38)

[QGQSGQ][WYSGGCEAFCGILSSGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVL]

Activatable antibody 15263-1204-SP34scFv(HvLv)-Fc fusion
Nucleotide sequence
[spacer (SEQ ID NO: 507)][Activatable antibody 15263-1204-SP34scFv(HvLv)-Fc fusion without spacer (SEQ ID NO: 573)]

(SEQ ID NO: 39)

```
[CAAGGCCAGTCTGGCCAA][TGGTATTCGGGTGGGTGCGAGGCTTTTTGCGGTATTTTGTCGTCGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTGGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]
```

Amino Acid sequence
[spacer (SEQ ID NO: 87)][Activatable antibody 15263-1204-SP34scFv(HvLv)-Fc fusion without spacer (SEQ ID NO: 574)]

(SEQ ID NO: 40)

[QGQSGQ][WYSGGCEAFCGILSSGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

-continued

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVLGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15860-1204-SP34scFv(HvLv)
Nucleotide sequence
[spacer (SEQ ID NO: 507)][15860-1204-SP34scFv(HvLv) without spacer (SEQ ID
NO: 575)]
(SEQ ID NO: 41)
[CAAGGCCAGTCTGGCCAA][GTTTATTATTGCGGTGGGAATGAGAGTCTGTGCGGTGAGAGGAGGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTG]

Amino Acid sequence
[spacer (SEQ ID NO: 87)][15860-1204-SP34scFv(HvLv) without spacer (SEQ ID
NO: 576)]
(SEQ ID NO: 42)
[QGQSGQ][VYYCGGNESLCGERRGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVL]

Activatable antibody 15860-1204-SP34scFv(HvLv)-Fc fusion
Nucleotide sequence
[spacer (SEQ ID NO: 507)][Activatable antibody 15860-1204-SP34scFv(HvLv)-Fc
fusion without spacer (SEQ ID NO: 577)]
(SEQ ID NO: 43)
[CAAGGCCAGTCTGGCCAA][GTTTATTATTGCGGTGGGAATGAGAGTCTGTGCGGTGAGAGGAGGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTGGGCGGCTCCCTGGACCCTAAGTCATCTGACAAAACTCACACA

TGCCCACCGTGCCCAGCACCTGAACTCCTGGGGGGACCGTCAGTCTTCCTCTTCCCCCCAAAACCCAAGGACACCCT

-continued

```
CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]

Amino Acid sequence
[spacer (SEQ ID NO: 87)][Activatable antibody 15860-1204-SP34scFv(HvLv)-Fc
fusion without spacer (SEQ ID NO: 578)]
                                                                    (SEQ ID NO: 44)
[QGQSGQ][VYYCGGNESLCGERRGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVLGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15864-1204-SP34scFv(HvLv)
Nucleotide sequence
[spacer (SEQ ID NO: 507)][15864-1204-SP34scFv(HvLv) without spacer (SEQ ID
NO: 579)]
                                                                    (SEQ ID NO: 45)
[CAAGGCCAGTCTGGCCAA][TTTATGTGCCAGCAGCGGATGTGGGGGAATGAGTTTTGCCATCAGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTG]

Amino Acid sequence
[spacer (SEQ ID NO: 87)][15864-1204-SP34scFv(HvLv) without spacer (SEQ ID
NO: 580)]
                                                                    (SEQ ID NO: 46)
[QGQSGQ][FMCQQRMWGNEFCHQGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVL]
```

Activatable antibody 15864-1204-SP34scFv(HvLv)-Fc fusion
[spacer (SEQ ID NO: 507)][Activatable antibody 15864-1204-SP34scFv(HvLv)-Fc
fusion without spacer (SEQ ID NO: 581)]

(SEQ ID NO: 47)

[CAAGGCCAGTCTGGCCAA][TTTATGTGCCAGCAGCGGATGTGGGGGAATGAGTTTTGCCATCAGGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTGGGCGGCTCCCTGGACCCTAAGTCATCTGACAAAACTCACACA

TGCCCACCGTGCCCAGCACCTGAACTCCTGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]

Amino Acid sequence
[spacer (SEQ ID NO: 87)][Activatable antibody 15864-1204-SP34scFv(HvLv)-Fc
fusion without spacer (SEQ ID NO: 582)]

(SEQ ID NO: 48)

[QGQSGQ][FMCQQRMWGNEFCHQGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVLGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

15865-1204-SP34scFv(HvLv)
Nucleotide sequence
[spacer (SEQ ID NO: 507)][15865-1204-SP34scFv(HvLv) without spacer (SEQ ID
NO: 583)]

(SEQ ID NO: 49)

[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

-continued

```
TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTG]
```

Amino Acid sequence
[spacer (SEQ ID NO: 87)][15865-1204-SP34scFv(HvLv) without spacer (SEQ ID
NO: 584)]

(SEQ ID NO: 50)
[QGQSGQ][MMYCGGNEVLCGPRVGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

LFTGLIGGTNKRAPGVPARFSGSLIGDKAALTITGAQTEDEAIYFCALWYSNLWVFGGGTKLTVL]

Activatable antibody 15865-1204-SP34 scFv(HvLv)-Fc fusion
Nucleotide sequence
[spacer (SEQ ID NO: 507)][Activatable antibody 15865-1204-SP34scFv(HvLv)-Fc
fusion without spacer (SEQ ID NO: 585)]

(SEQ ID NO: 51)

```
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTGAAGTGCAGCTGGTGGAAT

CTGGGGGCGGACTGGTGCAGCCTAAGGGCAGCCTGAAGCTGAGCTGTGCCGCCAGCGGCTTCACCTTCAACACCTAC

GCCATGAACTGGGTGCGCCAGGCCCCTGGCAAAGGCCTGGAATGGGTGGCCCGGATCAGAAGCAAGTACAACAATTA

CGCCACCTACTACGCCGACAGCGTGAAGGACAGATTCACCATCAGCCGGGACGACAGCCAGAGCATCCTGTACCTGC

AGATGAACAACCTGAAAACCGAGGACACCGCCATGTACTACTGCGTGCGGCACGGCAACTTCGGCAACAGCTATGTG

TCTTGGTTTGCCTACTGGGGCCAGGGCACCCTCGTGACAGTGTCTGCCGGTGGTGGTGGTAGTGGTGGCGGTGGTTC

AGGCGGTGGCGGTAGCCAGGCTGTCGTGACACAGGAAAGCGCCCTGACCACCAGCCCTGGCGAGACAGTGACCCTGA

CCTGTAGAAGCAGCACAGGCGCCGTGACCACAAGCAACTACGCCAATTGGGTGCAGGAAAAGCCCGACCACCTGTTC

ACCGGCCTGATCGGCGGCACCAACAAAAGGGCTCCAGGCGTGCCAGCCAGATTCAGCGGCTCCCTGATCGGAGATAA

GGCCGCCCTGACAATCACTGGCGCCCAGACCGAGGACGAGGCCATCTACTTTTGCGCCCTGTGGTACAGCAACCTGT

GGGTGTTCGGCGGAGGCACCAAGCTGACCGTGCTGGGCGGCTCCCTGGACCCTAAGTCATCTGACAAAACTCACACA

TGCCCACCGTGCCCAGCACCTGAACTCCTGGGGGACCGTCAGTCTTCCTCTTCCCCCCAAAACCCAAGGACACCCT

CATGATCTCCCGGACCCCTGAGGTCACATGCGTGGTGGTGGACGTGAGCCACGAAGACCCTGAGGTCAAGTTCAACT

GGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAAGGCTTCTATCCCAGCGACATCGCCGTG

GAGTGGGAGAGCAATGGGCAGCCGGAGAACAACTACAAGACCACGCCTCCCGTGCTGGACTCCGACGGCTCCTTCTT

CCTCTACAGCAAGCTCACCGTGGACAAGAGCAGGTGGCAGCAGGGGAACGTCTTCTCATGCTCCGTGATGCATGAGG

CTCTGCACAACCACTACACGCAGAAGAGCCTCTCCCTGTCTCCGGGTAAA]
```

Amino Acid sequence
[spacer (SEQ ID NO: 87)][Activatable antibody 15865-1204-SP34scFv(HvLv)-Fc
fusion without spacer (SEQ ID NO: 586)]

(SEQ ID NO: 52)
[QGQSGQ][MMYCGGNEVLCGPRVGSSGGSGGSGGLSGRSDNHGGGSEVQLVESGGGLVQPKGSLKLSCAASGFTFN

TYAMNWVRQAPGKGLEWVARIRSKYNNYATYYADSVKDRFTISRDDSQSILYLQMNNLKTEDTAMYYCVRHGNFGNS

YVSWFAYWGQGTLVTVSAGGGGSGGGGSGGGGSQAVVTQESALTTSPGETVTLTCRSSTGAVTTSNYANWVQEKPDH

-continued

LFTGLIGGTNKRAPGVPARFSGSLIGDKAALTITGAQTEDEAIYFCALWYSNLWVFGGGTKLTVLGGSLDPKSSDKT

HTCPPCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSVMHEALHNHYTQKSLSLSPGK]

Example 3. In Vitro Characterization of Activatable Anti-CD3ε Antibodies

This Example describes the ability of a masking moiety of the disclosure to reduce the ability of activatable anti-CD3ε antibodies of the disclosure comprising such a masking moiety to bind to CD3ε.

To determine if the masking peptides described in the previous examples could inhibit binding in the SP34 scFv-Fc context, a flow cytometry-based binding assay was performed. Jurkat T cells (Clone E6-1, ATCC, TIB-152) were cultured in RPMI-1640+glutamax (Life Technologies, Catalog 72400-120), 10% Heat Inactivated-Fetal Bovine Serum (HI-FBS, Life Technologies, Catalog 10438-026), 100 U/ml penicillin, and 100 μg/ml streptomycin (Life Technologies, Catalog 15140-122) according to ATCC guidelines. Cells were harvested by centrifugation (200×g, 4° C., 5 min) and re-suspended in PBS supplemented with 2% HI-FBS (FACS Buffer). About 180,000 Jurkats per well were transferred to a 96-well U-bottom plate, harvested, and re-suspended in 50 μL of primary antibody. The starting concentration of activatable antibody was 1 μM followed by 3-fold serial dilutions for a total of 12 concentrations. That following activatable antibodies were tested; 15003-1204-SP34scFv(LvHv)-Fc fusion; 15860-1204-SP34scFv (LvHv)-Fc fusion; 15864-1204-SP34scFv(LvHv)-Fc fusion; and 15865-1204-SP34scFv(LvHv)-Fc fusion; as was antibody SP34scFv(LvHv)-Fc.

Cells were incubated at 4° C. with shaking for about 1 hour, harvested, and washed with 3×200 μL of FACS Buffer. Jurkats were resuspended in 50 μl Alexa Fluor 488 conjugated anti-Human IgG Fc (1:100 dilution, Jackson ImmunoResearch, Product 109-546-098) and incubated at 4° C. with shaking for about 30 min. Cells were harvested, washed with 3×200 μL of FACS Buffer, and resuspended in a final volume of 120 μL of FACS Buffer. Samples were collected on a BD Accuri C6 (BD Biosciences) and the median fluorescence intensity (MFI) of viable cells was calculated using FlowJo V10 (Treestar). $EC_{50}$ values were calculated in GraphPad Prism 6 by curve fitting the data to log(agonist) vs. response (three parameters).

FIGS. 3A-3D demonstrate that incorporation of the masking peptides into the SP34 scFv-Fc context to produce activatable antibodies shifted the $EC_{50}$ values for CD3ε binding from single digit to triple digit nM.

Example 4. Bispecific Activatable Antibodies

This Example describes the production, expression and characterization of bispecific activatable antibodies of the disclosure.

Vector Construction:

The heavy chain and light chain were cloned separately into a mammalian expression vector using standard molecular biology techniques. Briefly, DNA fragments encoding the region of interest were amplified with primers binding to the terminal ends. Overlapping fragments were combined and amplified with flanking primers as needed to build the entire desired region. DNA fragments were subsequently cloned into expression vector using a commercially available homologous recombination kit (MCLabs, South San Francisco, Calif.). The in-house mammalian expression vector is a modified version of cDNA3.1(+) from Invitrogen with selection marker of G418 or hygromycin. Mutations were introduced using the QuikChange Kit (Agilent, Santa Clara, Calif.).

Bispecific antibodies and bispecific activatable antibodies were expressed in mammalian cells using standard transfection kit (Life Technologies, Grand Island, N.Y.). Briefly, 293 cells were transfected with nucleic acids using a lipid based system, following manufactures recommended protocol. Bispecific activatable antibodies and bispecific antibodies were purified from cell-free supernatant using Protein A beads (GE, Piscataway, N.J.) and concentrated using standard buffer exchange columns (Millipore, Temecula, Calif.).

Table 11 below describes the heavy chains and light chains for various bispecific antibodies and bispecific activatable antibodies of the disclosure.

TABLE 11

Bispecific antibodies and bispecific activatable antibodies

| Molecule Name | Molecule | Heavy Chain | Light Chain |
|---|---|---|---|
| CI005 | C225v5N297Q-CD3-H-N | pLW019: HC C225v5N297Q-CD3HvLv-H-N | OPP007: LC C225 |
| CI007 | 3954-1204-C225v5N297Q-CD3-H-N | pLW019: HC C225v5N297Q-CD3HvLv-H-N | OPP022: LC C225 3954-1204 |
| CI009 | C225v5N297Q-15865-CD3LvHv-H-N | pLW023: HC C225v5N297Q-15865-CD3LvHv-H-N | OPP007: LC C225 |
| CI010 | 3954-1204-C225v5N297Q-15003-CD3LvHv-H-N | pLW022: HC C225v5N297Q-15003-CD3LvHv-H-N | OPP022: LC C225 3954-1204 |

TABLE 11-continued

Bispecific antibodies and bispecific activatable antibodies

| Molecule Name | Molecule | Heavy Chain | Light Chain |
| --- | --- | --- | --- |
| CI011 | 3954-1204-C225v5N297Q-15865-CD3LvHv-H-N | pLW023: HC C225v5N297Q-15865-CD3LvHv-H-N | OPP022: LC C225 3954-1204 |
| CI012 | C225v5N297Q | pLW006: HC C225v5N297Q | OPP021: LC C225 |
| CI015 | C225v5N297Q-CD3LvHv-H-N | pLW057: HC C225v5N297Q-CD3LvHv-H-N | OPP021: LC C225 |
| CI016 | 3954-1204-C225v5N297Q-CD3LvHv-H-N | pLW057: HC C225v5N297Q-CD3LvHv-H-N | OPP022: LC C225 3954-1204 |
| CI021 | C225v5N297Q-15003-CD3HvLv-H-N | pLW047: HC C225v5N297Q-15003-CD3HvLv-H-N | OPP021: LC C225 |
| CI022 | C225v5N297Q-15865-CD3HvLv-H-N | pLW048: HC C225v5N297Q-15865-CD3HvLv-H-N | OPP021: LC C225 |
| CI023 | 3954-1204-C225v5N297Q-15003-CD3HvLv-H-N | pLW047: HC C225v5N297Q-15003-CD3HvLv-H-N | OPP022: LC C225 3954-1204 |
| CI024 | 3954-1204-C225v5N297Q-15865-CD3HvLv-H-N | pLW048: HC C225v5N297Q-15865-CD3HvLv-H-N | OPP022: LC C225 3954-1204 |
| CI025 | IL6RN297Q | pLW078: HC IL6RN297Q | pLW077: LC IL6R |
| CI026 | IL6RN297Q-CD3LvHv-H-N | pLW083: HC IL6RN297Q-CD3LvHv-H-N | pLW077: LC IL6R |
| CI027 | IL6RN297Q-15865_1204-CD3LvHv-H-N | pLW085: HC IL6RN297Q-15865_1204-CD3LvHv-H-N | pLW077: LC IL6R |
| CI028 | IL6R 4792 Nsub N297Q-15865_1204-CD3LvHv-H-N | pLW085: HC IL6RN297Q-15865_1204-CD3LvHv-H-N | pLW079: LC IL6R 4792 Nsub |
| CI029 | 4792-1204-IL6RN297Q-15865_1204-CD3LvHv-H-N | pLW085: HC IL6RN297Q-15865_1204-CD3LvHv-H-N | pLW080: LC IL6R 4792 1204 (C040) |
| CI030 | IL6RN297Q-15865_Nsub-CD3LvHv-H-N | pLW087: HC IL6RN297Q-15865_Nsub-CD3LvHv-H-N | pLW077: LC IL6R |
| CI031 | IL6R 4792 NsubN297Q-15865_Nsub-CD3LvHv-H-N | pLW087: HC IL6RN297Q-15865_Nsub-CD3LvHv-H-N | pLW079: LC IL6R 4792 Nsub |
| CI032 | 4792-1204-IL6RN297Q-15865_Nsub-CD3LvHv-H-N | pLW087: HC IL6RN297Q-15865_Nsub-CD3LvHv-H-N | pLW080: LC IL6R 4792 1204 |
| CI036 | 4792-1204-IL6RN297Q-CD3LvHv-H-N | pLW083: HC IL6RN297Q-CD3LvHv-H-N | pLW080: LC IL6R 4792 1204 |
| CI039 | 3954-2001-C225v5 N297Q-15865-2001-CD3LvHv-H-N | pLW101: HC C225v5N297Q-15865-2001-CD3LvHv-H-N | LC C225-3954-2001 |
| CI040 | 3954-2001C225v5N297Q-15865-2001-CD3LvHv-H-N | pLW101: HC C225v5N297Q-15865-2001-CD3LvHv-H-N | LC C225-3954-2001 |
| CI048 | activated bispecific activatable antibody C225N297Q-*CD3LvHv-H-N | pLW023: HC C225v5N297Q-15865-CD3LvHv-H-N | OPP022: LC C225 3954-1204 |
| CI049 | 3954-1204-C225v5N297Q-MC05-2001-mCD3-H-N | pLW121: HC C225v5N297Q-MC05-2001-mCD3-H-N | OPP022: LC C225 3954-1204 |
| CI050 | 3954-1204-C225v5N297Q-MC06-2001-mCD3-H-N | pLW122: HC C225v5N297Q-MC06-2001-mCD3-H-N | OPP022: LC C225 3954-1204 |
| CI051 | 3954-1204-C225v5N297Q-MC07-2001-mCD3-H-N | pLW123: HC C225v5N297Q-MC07-2001-mCD3-H-N | OPP022: LC C225 3954-1204 |
| CI052 | C225v5N297Q-mCD3-H-N | pLW100: HC C225v5N297Q-mCD3-H-N | OPP021: LC C225 |

TABLE 11-continued

Bispecific antibodies and bispecific activatable antibodies

| Molecule Name | Molecule | Heavy Chain | Light Chain |
|---|---|---|---|
| CI053 | 3954-1204-C225v5N297Q-MC01-2001-mCD3-H-N | pLW117: HC C225v5N297Q-MC01-2001-mCD3-H-N | OPP022: LC C225 3954-1204 |
| CI054 | 3954-1204-C225v5N297Q-MC02-2001-mCD3-H-N | pLW118: HC C225v5N297Q-MC02-2001-mCD3-H-N | OPP022: LC C225 3954-1204 |
| CI055 | 3954-1204-C225v5N297Q-MC03-2001-mCD3-H-N | pLW119: HC C225v5N297Q-MC03-2001-mCD3-H-N | OPP022: LC C225 3954-1204 |
| CI056 | 3954-1204-C225v5N297Q-MC04-2001-mCD3-H-N | pLW120: HC C225v5N297Q-MC04-2001-mCD3-H-N | OPP022: LC C225 3954-1204 |
| CI057 | 3954-1204-C225v5N297Q-MC08-2001-mCD3-H-N | pLW124: HC C225v5N297Q-MC08-2001-mCD3-H-N | OPP022: LC C225 3954-1204 |
| CI058 | 3954-1204-C225v5N297Q-MC09-2001-mCD3-H-N | pLW125: HC C225v5N297Q-MC09-2001-mCD3-H-N | OPP022: LC C225 3954-1204 |
| CI059 | BiTE | BiTE | |

Table 12A provide the primers used for each construct, and Table 12B provides the sequences of the primers used.

TABLE 12A

Primers

| Construct Name | Primers Used in Construction |
|---|---|
| BiTE | oLW017, oLW018 |
| pLW006 | oLW006, oLW007 |
| pLW019 | oLW048, oLW049, oLW050, oLW051 |
| pLW022 | oLW048, oLW061, oLW062, oLW063 |
| pLW023 | oLW048, oLW061, oLW062, oLW063 |
| pLW047 | oLW048, oLW049, oLW051, oLW098, oLW101, oLW102 |
| pLW048 | oLW048, oLW049, oLW051, oLW098, oLW101, oLW103 |
| pLW057 | oLW048, oLW056, oLW063, oLW109 |
| pLW077 | oLW048, oLW056, oLW115, oLW116 |
| pLW078 | oLW048, oLW049, oLW117, oLW118, oLW119, oLW120 |
| pLW080 | oLW048, oLW121 |
| pLW083 | oLW048, oLW123, oLW124, oLW125 |
| pLW085 | oLW048, oLW123, oLW124, oLW125 |
| pLW101 | oLW048, oLW151, oLW062, oLW063 |
| pLW117 | oLW048, oLW049, oLW178 |
| pLW118 | oLW048, oLW049, oLW178 |
| pLW119 | oLW048, oLW049, oLW178 |
| pLW120 | oLW048, oLW049, oLW178 |
| pLW121 | oLW048, oLW049, oLW178 |
| pLW122 | oLW048, oLW049, oLW178 |
| pLW123 | oLW048, oLW049, oLW178 |
| pLW124 | oLW048, oLW049, oLW178 |
| pLW125 | oLW048, oLW049, oLW178 |

TABLE 12B

Primer Sequences

| Primer Name | Primer Sequence | SEQ ID NO: |
|---|---|---|
| oLW001 | CATACACTGGTATCAGCAAAGAACACAGGGTTCTCCAAGGC | 412 |
| oLW002 | GCCTTGGAGAACCCTGTGTTCTTTGCTGATACCAGTGTATG | 413 |
| oLW003 | TTTAAAATGAACAGTCTGCAATCTCAGGACACAGCCATATATTACTGTGCC | 414 |
| oLW004 | GGCACAGTAATATATGGCTGTGTCCTGAGATTGCAGACTGTTCATTTTAAA | 415 |
| oLW006 | CGGGAGGAGCAGTACCAGAGCACGTACCGTGTG | 416 |
| oLW007 | CACACGGTACGTGCTCTGGTACTGCTCCTCCCG | 417 |
| oLW017 | CACCCCATTGACGTCAATGGGAG | 418 |
| oLW018 | GAGGGGCAAACAACAGATGGCTG | 419 |
| oLW048 | TGAACCGTCAGATCACTAGAAGCTTTATTGC | 420 |
| oLW049 | TGGATGTGCACCAGGTGTGACAGC | 421 |
| oLW050 | CTGGCTGTCACACCTGGTGCACATCCAGAGGTGCAGCTGGTCGAGTCTGG | 422 |
| oLW051 | AGCTGCACCTGGGATCCACCACCTCCTAGGACAGTCAGTTTGGTTCCTCCACC | 423 |
| oLW056 | ACATCTAGCACCACGCAGCCATAGTAGC | 424 |
| oLW061 | GTGACCACGGTCTGAGAACCGCCGCCATGATTATCGG | 425 |
| oLW062 | GGCGGCGGTTCTCAGACCGTGGTCACACAGGAGCC | 426 |
| oLW063 | CTCTGTTTCAGCTGCACCTGGGATCCACCACCTCCTGAGGAGACGGTGACCAGTGTCCC | 427 |
| oLW098 | AGAACCGCCGCCATGATTATCG | 428 |
| oLW101 | CGTTCCGATAATCATGGCGGCGGTTCTGAGGTGCAGCTGGTCGAGTCTGG | 429 |
| oLW102 | CTGGCTGTCACACCTGGTGCACATCCACAAGGCCAGTCTGGCCAAGGTTATC | 430 |
| oLW103 | CTGGCTGTCACACCTGGTGCACATCCACAAGGCCAGTCTGGCCAAATGATG | 431 |

TABLE 12B -continued

Primer Sequences

| Primer Name | Primer Sequence | SEQ ID NO: |
|---|---|---|
| oLW109 | CTCCTGCTACTATGGCTGCGTGGTGCTAGATGTCAG ACCGTGGTCACACAGGAGCC | 432 |
| oLW115 | CTCCTGCTACTATGGCTGCGTGGTGCTAGATGTGAC ATCCAGATGACTCAGTCTCCTAGCTCC | 433 |
| oLW116 | GAAGACAGATGGTGCAGCCACCG | 434 |
| oLW117 | CTGGCTGTCACACCTGGTGCACATCCACAGGTGCAG CTGCAGGAGTCCG | 435 |
| oLW118 | GCTAGCACCAAGGGCCCATCG | 436 |
| oLW119 | GGAAGACCGATGGGCCCTTGG | 437 |
| oLW120 | GCCCTCTAGACTCGAGCGGCCGCTCATTTACCCGGA GACAGGGAGAG | 438 |
| oLW121 | GCAGGACCCATACTGGCCAGACTGGCCTTGACATCT AGCACCACGCAGCCATAGTAGC | 439 |
| oLW123 | GGAGGTGGTGGATCCCAGGTGCAGCTGCAGGAGTCC G | 440 |
| oLW124 | CAGCTGCACCTGGGATCCACCACCTCCTGAGGAGAC G | 441 |
| oLW125 | ACCGATGGGCCCTTGGTGCTAG | 442 |
| oLW151 | GACCACGGTCTGAGAACCGCCG | 443 |
| oLW178 | CACCTGGTGCACATCCACAAGGC | 444 |

The sequences for the bispecific antibodies and bispecific activatable antibodies are shown below. In some embodiments, the activatable antibody also includes a spacer sequence. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. In some embodiments, the spacer joined directly to the N-terminus of MM of the activatable antibody is selected from the group consisting of QGQSGQG (SEQ ID NO: 407), QGQSGQ (SEQ ID NO: 87), QGQSG (SEQ ID NO: 408), QGQS (SEQ ID NO: 409), QGQ (SEQ ID NO: 410), QG (SEQ ID NO: 411), and Q. In some embodiments, the spacer includes at least the amino acid sequence QGQSGQG (SEQ ID NO: 412). In some embodiments, the spacer includes at least the amino acid sequence QGQSGQG (SEQ ID NO: 407). In some embodiments, the spacer includes at least the amino acid sequence QGQSGQ (SEQ ID NO: 87). In some embodiments, the spacer includes at least the amino acid sequence QGQSG (SEQ ID NO: 408). In some embodiments, the spacer includes at least the amino acid sequence QGQS (SEQ ID NO: 409), In some embodiments, the spacer includes at least the amino acid sequence QGQ (SEQ ID NO: 410). In some embodiments, the spacer includes at least the amino acid sequence QG (SEQ ID NO: 411). In some embodiments, the spacer includes at least the amino acid residue Q.

While some of the sequences shown below include the spacer sequence of SEQ ID NO: 362, those of ordinary skill in the art appreciate that the multispecific activatable antibodies of the disclosure can include any suitable spacer sequence, such as, for example, a spacer sequence selected from the group consisting of QGQSGQG (SEQ ID NO: 407), QGQSGQ (SEQ ID NO: 87), QGQSG (SEQ ID NO: 408), QGQS (SEQ ID NO: 409), QGQ (SEQ ID NO: 410), QG (SEQ ID NO: 411), and Q.

```
CI005: C225v5N297Q-CD3-H-N
pLW019: HC C225v5N297Q-CD3HvLv-H-N
Nucleotide Sequence
                                                        (SEQ ID NO: 445)
GAGGTGCAGCTGGTCGAGTCTGGAGGAGGATTGGTGCAGCCTGGAGGGTCATTGAAACTCTCATGTGCAGCCTCTGG

ATTCACCTTCAATAAGTACGCCATGAACTGGGTCCGCCAGGCTCCAGGAAAGGGTTTGGAATGGGTTGCTCGCATAA

GAAGTAAATATAATAATTATGCAACATATTATGCCGATTCAGTGAAAGACAGGTTCACCATCTCCAGAGATGATTCA

AAAAACACTGCCTATCTACAAATGAACAACTTGAAAACTGAGGACACTGCCGTGTACTACTGTGTGAGACATGGGAA

CTTCGGTAATAGCTACATATCCTACTGGGCTTACTGGGGCCAAGGGACTCTGGTCACCGTCTCCTCAGGTGGTGGTG

GTTCTGGCGGCGGCGGCTCCGGTGGTGGTGGTTCTCAGACTGTTGTGACTCAGGAACCTTCACTCACCGTATCACCT

GGTGGAACAGTCACACTCACTTGTGGCTCCTCGACTGGGGCTGTTACATCTGGCTACTACCCAAACTGGGTCCAACA

AAAACCAGGTCAGGCACCCCGTGGTCTAATAGGTGGGACTAAGTTCCTCGCCCCCGGTACTCCTGCCAGATTCTCAG

GCTCCCTGCTTGGAGGCAAGGCTGCCCTCACCCTCTCAGGGGTACAGCCAGAGGATGAGGCAGAATATTACTGTGCT

CTATGGTACAGCAACCGCTGGGTGTTCGGTGGAGGAACCAAACTGACTGTCCTAGGAGGTGGTGGATCCCAGGTGCA

GCTGAAACAGAGCGGCCCGGGCCTGGTGCAGCCGAGCCAGAGCCTGAGCATTACCTGCACCGTGAGCGGCTTTAGCC

TGACCAACTATGGCGTGCATTGGGTGCGCCAGAGCCCGGGCAAAGGCCTGGAATGGCTGGGCGTGATTTGGAGCGGC

GGCAACACCGATTATAACACCCCGTTTACCAGCCGCCTGAGCATTAACAAAGATAACAGCAAAAGCCAGGTGTTTTT

TAAAATGAACAGCCTGCAAAGCCAGGATACCGCGATTTATTATTGCGCGCGCGCGCTGACCTATTATGATTATGAAT

TTGCGTATTGGGGCCAGGGCACCCTGGTGACCGTGAGCGCGGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC
```

-continued

```
GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA
```

Amino Acid Sequence (SEQ ID NO: 446)

```
EVQLVESGGGLVQPGGSLKLSCAASGFTFNKYAMNWVRQAPGKGLEWVARIRSKYNNYATYYADSVKDRFTISRDDS

KNTAYLQMNNLKTEDTAVYYCVRHGNFGNSYISYWAYWGQGTLVTVSSGGGGSGGGGSGGGGSQTVVTQEPSLTVSP

GGTVTLTCGSSTGAVTSGYYPNWVQQKPGQAPRGLIGGTKFLAPGTPARFSGSLLGGKAALTLSGVQPEDEAEYYCA

LWYSNRWVFGGGTKLTVLGGGGSQVQLKQSGPGLVQPSQSLSITCTVSGFSLTNYGVHWVRQSPGKGLEWLGVIWSG

GNTDYNTPFTSRLSINKDNSKSQVFFKMNSLQSQDTAIYYCARALTYYDYEFAYWGQGTLVTVSAASTKGPSVFPLA

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK*
```

OPP007: LC C225 IL2ss
Nucleotide Sequence (SEQ ID NO: 447)

```
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAACTGAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG
```

Amino Acid Sequence (SEQ ID NO: 448)

```
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLELKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*
```

-continued

CI007: 3954-1204-C225v5N297Q-CD3-H-N
pLW019: HC C225v5N297Q-CD3HvLv-H-N
Nucleotide Sequence (SEQ ID NO: 445)

GAGGTGCAGCTGGTCGAGTCTGGAGGAGGATTGGTGCAGCCTGGAGGGTCATTGAAACTCTCATGTGCAGCCTCTGG

ATTCACCTTCAATAAGTACGCCATGAACTGGGTCCGCCAGGCTCCAGGAAAGGGTTTGGAATGGGTTGCTCGCATAA

GAAGTAAATATAATAATTATGCAACATATTATGCCGATTCAGTGAAAGACAGGTTCACCATCTCCAGAGATGATTCA

AAAAACACTGCCTATCTACAAATGAACAACTTGAAAACTGAGGACACTGCCGTGTACTACTGTGTGAGACATGGGAA

CTTCGGTAATAGCTACATATCCTACTGGGCTTACTGGGGCCAAGGGACTCTGGTCACCGTCTCCTCAGGTGGTGGTG

GTTCTGGCGGCGGCGGCTCCGGTGGTGGTGGTTCTCAGACTGTTGTGACTCAGGAACCTTCACTCACCGTATCACCT

GGTGGAACAGTCACACTCACTTGTGGCTCCTCGACTGGGGCTGTTACATCTGGCTACTACCCAAACTGGGTCCAACA

AAACCAGGTCAGGCACCCCGTGGTCTAATAGGTGGGACTAAGTTCCTCGCCCCCGGTACTCCTGCCAGATTCTCAG

GCTCCCTGCTTGGAGGCAAGGCTGCCCTCACCCTCTCAGGGGTACAGCCAGAGGATGAGGCAGAATATTACTGTGCT

CTATGGTACAGCAACCGCTGGGTGTTCGGTGGAGGAACCAAACTGACTGTCCTAGGAGGTGGTGGATCCCAGGTGCA

GCTGAAACAGAGCGGCCCGGGCCTGGTGCAGCCGAGCCAGAGCCTGAGCATTACCTGCACCGTGAGCGGCTTTAGCC

TGACCAACTATGGCGTGCATTGGGTGCGCCAGAGCCCGGGCAAAGGCCTGGAATGGCTGGGCGTGATTTGGAGCGGC

GGCAACACCGATTATAACACCCCGTTTACCAGCCGCCTGAGCATTAACAAAGATAACAGCAAAAGCCAGGTGTTTTT

TAAAATGAACAGCCTGCAAAGCCAGGATACCGCGATTTATTATTGCGCGCGCGCGCTGACCTATTATGATTATGAAT

TTGCGTATTGGGGCCAGGGCACCCTGGTGACCGTGAGCGCGGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA

Amino Acid Sequence (SEQ ID NO: 446)

EVQLVESGGGLVQPGGSLKLSCAASGFTFNKYAMNWVRQAPGKGLEWVARIRSKYNNYATYYADSVKDRFTISRDDS

KNTAYLQMNNLKTEDTAVYYCVRHGNFGNSYISYWAYWGQGTLVTVSSGGGGSGGGGSGGGGSQTVVTQEPSLTVSP

GGTVTLTCGSSTGAVTSGYYPNWVQQKPGQAPRGLIGGTKFLAPGTPARFSGSLLGGKAALTLSGVQPEDEAEYYCA

LWYSNRWVFGGGTKLTVLGGGGSQVQLKQSGPGLVQPSQSLSITCTVSGFSLTNYGVHWVRQSPGKGLEWLGVIWSG

GNTDYNTPFTSRLSINKDNSKSQVFFKMNSLQSQDTAIYYCARALTYYDYEFAYWGQGTLVTVSAASTKGPSVFPLA

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK*

OPP022: LC C225 3954-1204
Nucleotide Sequence
[spacer (SEQ ID NO: 507)][OPP022 without spacer (SEQ ID NO: 509)]
(SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI009: C225v5N297Q-15865-CD3LvHv-H-N
pLW023: C225v5N297Q-15865-CD3LvHv-H-N
Nucleotide Sequence
[spacer (SEQ ID NO: 507)][pLW023 without spacer (SEQ ID NO: 511)]
(SEQ ID NO: 451)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGAAACAGAGCGGCCCG

GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

```
CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

Amino Acid Sequence
[spacer (SEQ ID NO: 87)][pLW023 without spacer (SEQ ID NO: 512)]
                                                                    (SEQ ID NO: 452)
[QGQSGQ][MMYCGGNEVLCGPRVGSSGGSGGSGGLSGRSDNHGGGSQTVVTQEPSLTVSPGGTVTLTCRSSTGAVT

TSNYANWVQQKPGQAPRGLIGGTNKRAPGTPARFSGSLLGGKAALTLSGVQPEDEAEYYCALWYSNLWVFGGGTKLT

VLGGGGSGGGGSGGGGSEVQLVESGGGLVQPGGSLKLSCAASGFTFNTYAMNWVRQAPGKGLEWVARIRSKYNNYAT

YYADSVKDRFTISRDDSKNTAYLQMNNLKTEDTAVYYCVRHGNFGNSYVSWFAYWGQGTLVTVSSGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP007: LC C225 IL2ss
Nucleotide Sequence
                                                                    (SEQ ID NO: 447)
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAACTGAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence
                                                                    (SEQ ID NO: 448)
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLELKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*
```

```
CI010: 3954-1204-C225v5N297Q-15003-CD3LvHv-H-N
pLW022: C225v5N297Q-15865-CD3LvHv-H-N
Nucleotide Sequence
[spacer (SEQ ID NO: 507)][pLW022 without spacer (SEQ ID NO: 895)]
                                                                (SEQ ID NO: 451)
[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGAAACAGAGCGGCCCG

GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

Amino Acid Sequence
[spacer (SEQ ID NO: 87)][pLW022 without spacer (SEQ ID NO: 510)]
                                                                (SEQ ID NO: 454)
[QGQSGQ][GYRWGCEWNCGGITTGSSGGSGGSGGLSGRSDNHGGGSQTVVTQEPSLTVSPGGTVTLTCRSSTGAVT

TSNYANWVQQKPGQAPRGLIGGTNKRAPGTPARFSGSLLGGKAALTLSGVQPEDEAEYYCALWYSNLWVFGGGTKLT

VLGGGGSGGGGSGGGGSEVQLVESGGGLVQPGGSLKLSCAASGFTFNTYAMNWVRQAPGKGLEWVARIRSKYNNYAT

YYADSVKDRFTISRDDSKNTAYLQMNNLKTEDTAVYYCVRHGNFGNSYVSWFAYWGQGTLVTVSSGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN
```

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC*]

CI011: 3954-1204-C225v5N297Q-15865-CD3LvHv-H-N
pLW023: HC C225v5N297Q-15865-CD3LvHv-H-N
Nucleotide Sequence
[spacer (SEQ ID NO: 507)][pLW023 without spacer (SEQ ID NO: 511)]
(SEQ ID NO: 451)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGAAACAGAGCGGCCCG

GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

-continued

```
CACCCTGGTGACCGTGAGCGCGGCTAGCACCAAGGGCCCATCGGTCTTCCCCCTGGCACCCTCCTCCAAGAGCACCT
CTGGGGGCACAGCGGCCCTGGGCTGCCTGGTCAAGGACTACTTCCCCGAACCGGTGACGGTGTCGTGGAACTCAGGC
GCCCTGACCAGCGGCGTGCACACCTTCCCGGCTGTCCTACAGTCCTCAGGACTCTACTCCCTCAGCAGCGTGGTGAC
CGTGCCCTCCAGCAGCTTGGGCACCCAGACCTACATCTGCAACGTGAATCACAAGCCCAGCAACACCAAGGTGGACA
AGAAAGTTGAGCCCAAATCTTGTGACAAAACTCACACATGCCCACCGTGCCCAGCACCTGAACTCCTGGGGGGACCG
TCAGTCTTCCTCTTCCCCCCAAAACCCAAGGACACCCTCATGATCTCCCGGACCCCTGAGGTCACATGCGTGGTGGT
GGACGTGAGCCACGAAGACCCTGAGGTCAAGTTCAACTGGTACGTGGACGGCGTGGAGGTGCATAATGCCAAGACAA
AGCCGCGGGAGGAGCAGTACCAGAGCACGTACCGTGTGGTCAGCGTCCTCACCGTCCTGCACCAGGACTGGCTGAAT
GGCAAGGAGTACAAGTGCAAGGTCTCCAACAAAGCCCTCCCAGCCCCCATCGAGAAAACCATCTCCAAAGCCAAAGG
GCAGCCCCGAGAACCACAGGTGTACACCCTGCCCCCATCCCGGGAGGAGATGACCAAGAACCAGGTCAGCCTGACCT
GCCTGGTCAAAGGCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTACACGCAGAAGAGCCTCTCCCTGT
CTCCGGGTAAATGA]
```

Amino Acid Sequence
[spacer (SEQ ID NO: 87)][pLW023 without spacer (SEQ ID NO: 512)]
(SEQ ID NO: 452)
[QGQSGQ][MMYCGGNEVLCGPRVGSSGGSGGSGGLSGRSDNHGGGSQTVVTQEPSLTVSPGGTVTLTCRSSTGAVT
TSNYANWVQQKPGQAPRGLIGGTNKRAPGTPARFSGSLLGGKAALTLSGVQPEDEAEYYCALWYSNLWVFGGGTKLT
VLGGGGSGGGGSGGGGSEVQLVESGGGLVQPGGSLKLSCAASGFTFNTYAMNWVRQAPGKGLEWVARIRSKYNNYAT
YYADSVKDRFTISRDDSKNTAYLQMNNLKTEDTAVYYCVRHGNFGNSYVSWFAYWGQGTLVTVSSGGGGSQVQLKQS
GPGLVQPSQSLSITCTVSGFSLTNYGVHWVRQSPGKGLEWLGVIWSGGNTDYNTPFTSRLSINKDNSKSQVFFKMNS
LQSQDTAIYYCARALTYYDYEFAYWGQGTLVTVSAASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK]

OPP022: LC C225 3954-1204
Nucleotide Sequence
[spacer (SEQ ID NO: 507)][OPP022 without spacer (SEQ ID NO: 509)]
(SEQ ID NO: 449)

```
[CAAGGCCAGTCTGGCCAG][TGCATCTCACCTCGTGGTTGTCCGGACGGCCCATACGTCATGTACGGCTCGAGCGG
TGGCAGCGGTGGCTCTGGTGGATCCGGTCTGAGCGGCCGTTCCGATAATCATGGCAGTAGCGGTACCCAGATCTTGC
TGACCCAGAGCCCGGTGATTCTGAGCGTGAGCCCGGGCGAACGTGTGAGCTTTAGCTGCCGCGCGAGCCAGAGCATT
GGCACCAACATTCATTGGTATCAGCAGCGCACCAACGGCAGCCCGCGCCTGCTGATTAAATATGCGAGCGAAAGCAT
TAGCGGCATTCCGAGCCGCTTTAGCGGCAGCGGCAGCGGCACCGATTTTACCCTGAGCATTAACAGCGTGGAAAGCG
AAGATATTGCGGATTATTATTGCCAGCAGAACAACAACTGGCCGACCACCTTTGGCGCGGGCACCAAACTGGAACTG
AAACGTACGGTGGCTGCACCATCTGTCTTCATCTTCCCGCCATCTGATGAGCAGTTGAAATCTGGAACTGCCTCTGT
TGTGTGCCTGCTGAATAACTTCTATCCCAGAGAGGCCAAAGTACAGTGGAAGGTGGATAACGCCCTCCAATCGGGTA
ACTCCCAGGAGAGTGTCACAGAGCAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTGAGCTCGCCCGTCACAAAGAGCTT
CAACAGGGGAGAGTGTTAG]
```

-continued

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]

CI012: C225v5N297Q
pLW006: C225v5N297Q
Nucleotide Sequence
(SEQ ID NO: 455)
CAGGTGCAGCTGAAACAGAGCGGCCCGGGCCTGGTGCAGCCGAGCCAGAGCCTGAGCATTACCTGCACCGTGAGCGG

CTTTAGCCTGACCAACTATGGCGTGCATTGGGTGCGCCAGAGCCCGGGCAAAGGCCTGGAATGGCTGGGCGTGATTT

GGAGCGGCGGCAACACCGATTATAACACCCCGTTTACCAGCCGCCTGAGCATTAACAAAGATAACAGCAAAAGCCAG

GTGTTTTTTAAAATGAACAGCCTGCAAAGCCAGGATACCGCGATTTATTATTGCGCGCGCGCGCTGACCTATTATGA

TTATGAATTTGCGTATTGGGGCCAGGGCACCCTGGTGACCGTGAGCGCGGCTAGCACCAAGGGCCCATCGGTCTTCC

CCCTGGCACCCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCCCTGACCAGCGGCGTGCACACCTTCCCGGCTGTCCTACAGTCCTCAGG

ACTCTACTCCCTCAGCAGCGTGGTGACCGTGCCCTCCAGCAGCTTGGGCACCCAGACCTACATCTGCAACGTGAATC

ACAAGCCCAGCAACACCAAGGTGGACAAGAAAGTTGAGCCCAAATCTTGTGACAAAACTCACACATGCCCACCGTGC

CCAGCACCTGAACTCCTGGGGGGACCGTCAGTCTTCCTCTTCCCCCCAAAACCCAAGGACACCCTCATGATCTCCCG

GACCCCTGAGGTCACATGCGTGGTGGTGGACGTGAGCCACGAAGACCCTGAGGTCAAGTTCAACTGGTACGTGGACG

GCGTGGAGGTGCATAATGCCAAGACAAAGCCGCGGGAGGAGCAGTACCAGAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCAT

CGAGAAAACCATCTCCAAAGCCAAAGGGCAGCCCCGAGAACCACAGGTGTACACCCTGCCCCCATCCCGGGAGGAGA

TGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAA

GCTCACCGTGGACAAGAGCAGGTGGCAGCAGGGGAACGTCTTCTCATGCTCCGTGATGCATGAGGCTCTGCACAACC

ACTACACGCAGAAGAGCCTCTCCCTGTCTCCGGGTAAATGA

Amino Acid Sequence
(SEQ ID NO: 456)
QVQLKQSGPGLVQPSQSLSITCTVSGFSLTNYGVHWVRQSPGKGLEWLGVIWSGGNTDYNTPFTSRLSINKDNSKSQ

VFFKMNSLQSQDTAIYYCARALTYYDYEFAYWGQGTLVTVSAASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYQSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK*

OPP021: LC C225
Nucleotide Sequence
(SEQ ID NO: 457)
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

-continued

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence
(SEQ ID NO: 458)
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI015: C225v5N297Q-CD3LvHv-H-N
pLW057: HC C225v5N297Q-CD3LvHv-H-N
Nucleotide Sequence
(SEQ ID NO: 459)
CAGACCGTGGTCACACAGGAGCCCTCACTGACAGTGAGCCCTGGCGGGACCGTCACACTGACTTGTCGCAGTTCAAC

TGGCGCCGTGACTACCAGCAATTACGCTAACTGGGTCCAGCAGAAACCAGGACAGGCACCACGAGGACTGATCGGAG

GAACTAATAAGAGAGCACCAGGAACCCCTGCAAGGTTCTCCGGATCTCTGCTGGGGGGAAAAGCCGCTCTGACACTG

AGCGGCGTGCAGCCTGAGGACGAAGCTGAGTACTATTGCGCACTGTGGTACTCCAACCTGTGGGTGTTTGGCGGGGG

AACTAAGCTGACCGTCCTGGGAGGAGGAGGAAGCGGAGGAGGAGGGAGCGGAGGAGGAGGATCCGAAGTGCAGCTGG

TCGAGAGCGGAGGAGGACTGGTGCAGCCAGGAGGATCCCTGAAGCTGTCTTGTGCAGCCAGTGGCTTCACCTTCAAC

ACTTACGCAATGAACTGGGTGCGGCAGGCACCTGGGAAGGGACTGGAATGGGTCGCCCGGATCAGATCTAAATACAA

TAACTATGCCACCTACTATGCTGACAGTGTGAAGGATAGGTTCACCATTTCACGCGACGATAGCAAAAACACAGCTT

ATCTGCAGATGAATAACCTGAAGACCGAGGATACAGCAGTGTACTATTGCGTCAGACACGGCAATTTCGGGAACTCT

TACGTGAGTTGGTTTGCCTATTGGGGACAGGGGACACTGGTCACCGTCTCCTCAGGAGGTGGTGGATCCCAGGTGCA

GCTGAAACAGAGCGGCCCGGGCCTGGTGCAGCCGAGCCAGAGCCTGAGCATTACCTGCACCGTGAGCGGCTTTAGCC

TGACCAACTATGGCGTGCATTGGGTGCGCCAGAGCCCGGGCAAAGGCCTGGAATGGCTGGGCGTGATTTGGAGCGGC

GGCAACACCGATTATAACACCCCGTTTACCAGCCGCCTGAGCATTAACAAAGATAACAGCAAAAGCCAGGTGTTTTT

TAAAATGAACAGCCTGCAAAGCCAGGATACCGCGATTTATTATTGCGCGCGCGCTGACCTATTATGATTATGAAT

TTGCGTATTGGGGCCAGGGCACCCTGGTGACCGTGAGCGCGGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA

Amino Acid Sequence
(SEQ ID NO: 460)
QTVVTQEPSLTVSPGGTVTLTCRSSTGAVTTSNYANWVQQKPGQAPRGLIGGTNKRAPGTPARFSGSLLGGKAALTL

SGVQPEDEAEYYCALWYSNLWVFGGGTKLTVLGGGGSGGGGSGGGGSEVQLVESGGGLVQPGGSLKLSCAASGFTFN

TYAMNWVRQAPGKGLEWVARIRSKYNNYATYYADSVKDRFTISRDDSKNTAYLQMNNLKTEDTAVYYCVRHGNFGNS

YVSWFAYWGQGTLVTVSSGGGGSQVQLKQSGPGLVQPSQSLSITCTVSGFSLTNYGVHWVRQSPGKGLEWLGVIWSG

GNTDYNTPFTSRLSINKDNSKSQVFFKMNSLQSQDTAIYYCARALTYYDYEFAYWGQGTLVTVSAASTKGPSVFPLA

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK*

OPP021: LC C225
Nucleotide Sequence
(SEQ ID NO: 457)
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence
(SEQ ID NO: 458)
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI016: 3954-1204-C225v5N297Q-CD3LvHv-H-N
pLW057: HC C225v5N297Q-CD3LvHv-H-N
Nucleotide Sequence
(SEQ ID NO: 459)
CAGACCGTGGTCACACAGGAGCCCTCACTGACAGTGAGCCCTGGCGGGACCGTCACACTGACTTGTCGCAGTTCAAC

TGGCGCCGTGACTACCAGCAATTACGCTAACTGGGTCCAGCAGAAACCAGGACAGGCACCACGAGGACTGATCGGAG

GAACTAATAAGAGAGCACCAGGAACCCCTGCAAGGTTCTCCGGATCTCTGCTGGGGGGAAAAGCCGCTCTGACACTG

AGCGGCGTGCAGCCTGAGGACGAAGCTGAGTACTATTGCGCACTGTGGTACTCCAACCTGTGGGTGTTTGGCGGGGG

AACTAAGCTGACCGTCCTGGGAGGAGGAGGAAGCGGAGGAGGAGGGAGCGGAGGAGGAGGATCCGAAGTGCAGCTGG

TCGAGAGCGGAGGAGGACTGGTGCAGCCAGGAGGATCCCTGAAGCTGTCTTGTGCAGCCAGTGGCTTCACCTTCAAC

ACTTACGCAATGAACTGGGTCGGCAGGCACCTGGGAAGGGACTGGAATGGGTCGCCCGGATCAGATCTAAATACAA

TAACTATGCCACCTACTATGCTGACAGTGTGAAGGATAGGTTCACCATTTCACGCGACGATAGCAAAAACACAGCTT

ATCTGCAGATGAATAACCTGAAGACCGAGGATACAGCAGTGTACTATTGCGTCAGACACGGCAATTTCGGGAACTCT

TACGTGAGTTGGTTTGCCTATTGGGGACAGGGGACACTGGTCACCGTCTCCTCAGGAGGTGGTGGATCCCAGGTGCA

GCTGAAACAGAGCGGCCCGGGCCTGGTGCAGCCGAGCCAGAGCCTGAGCATTACCTGCACCGTGAGCGGCTTTAGCC

TGACCAACTATGGCGTGCATTGGGTGCGCCAGAGCCCGGGCAAAGGCCTGGAATGGCTGGGCGTGATTTGGAGCGGC

GGCAACACCGATTATAACACCCCGTTTACCAGCCGCCTGAGCATTAACAAAGATAACAGCAAAAGCCAGGTGTTTTT

TAAAATGAACAGCCTGCAAAGCCAGGATACCGCGATTTATTATTGCGCGCGCGCGCTGACCTATTATGATTATGAAT

TTGCGTATTGGGGCCAGGGCACCCTGGTGACCGTGAGCGCGGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCGGCTGTCCTACAGTCCTCAGGACTCTACT

-continued

```
CCCTCAGCAGCGTGGTGACCGTGCCCTCCAGCAGCTTGGGCACCCAGACCTACATCTGCAACGTGAATCACAAGCCC
AGCAACACCAAGGTGGACAAGAAAGTTGAGCCCAAATCTTGTGACAAAACTCACACATGCCCACCGTGCCCAGCACC
TGAACTCCTGGGGGGACCGTCAGTCTTCCTCTTCCCCCCAAAACCCAAGGACACCCTCATGATCTCCCGGACCCCTG
AGGTCACATGCGTGGTGGTGGACGTGAGCCACGAAGACCCTGAGGTCAAGTTCAACTGGTACGTGGACGGCGTGGAG
GTGCATAATGCCAAGACAAAGCCGCGGGAGGAGCAGTACCAGAGCACGTACCGTGTGGTCAGCGTCCTCACCGTCCT
GCACCAGGACTGGCTGAATGGCAAGGAGTACAAGTGCAAGGTCTCCAACAAAGCCCTCCCAGCCCCCATCGAGAAAA
CCATCTCCAAAGCCAAAGGGCAGCCCCGAGAACCACAGGTGTACACCCTGCCCCCATCCCGGGAGGAGATGACCAAG
AACCAGGTCAGCCTGACCTGCCTGGTCAAAGGCTTCTATCCCAGCGACATCGCCGTGGAGTGGGAGAGCAATGGGCA
GCCGGAGAACAACTACAAGACCACGCCTCCCGTGCTGGACTCCGACGGCTCCTTCTTCCTCTACAGCAAGCTCACCG
TGGACAAGAGCAGGTGGCAGCAGGGGAACGTCTTCTCATGCTCCGTGATGCATGAGGCTCTGCACAACCACTACACG
CAGAAGAGCCTCTCCCTGTCTCCGGGTAAATGA
```

Amino Acid Sequence
(SEQ ID NO: 460)
```
QTVVTQEPSLTVSPGGTVTLTCRSSTGAVTTSNYANWVQQKPGQAPRGLIGGTNKRAPGTPARFSGSLLGGKAALTL
SGVQPEDEAEYYCALWYSNLWVFGGGTKLTVLGGGGSGGGGSGGGGSEVQLVESGGGLVQPGGSLKLSCAASGFTFN
TYAMNWVRQAPGKGLEWVARIRSKYNNYATYYADSVKDRFTISRDDSKNTAYLQMNNLKTEDTAVYYCVRHGNFGNS
YVSWFAYWGQGTLVTVSSGGGGSQVQLKQSGPGLVQPSQSLSITCTVSGFSLTNYGVHWVRQSPGKGLEWLGVIWSG
GNTDYNTPFTSRLSINKDNSKSQVFFKMNSLQSQDTAIYYCARALTYYDYEFAYWGQGTLVTVSAASTKGPSVFPLA
PSSKSTSGGTAALGCLVKDYFPEPVTVSWNSGALTSGVHTFPAVLQSSGLYSLSSVVTVPSSSLGTQTYICNVNHKP
SNTKVDKKVEPKSCDKTHTCPPCPAPELLGGPSVFLFPPKPKDTLMISRTPEVTCVVVDVSHEDPEVKFNWYVDGVE
VHNAKTKPREEQYQSTYRVVSVLTVLHQDWLNGKEYKCKVSNKALPAPIEKTISKAKGQPREPQVYTLPPSREEMTK
NQVSLTCLVKGFYPSDIAVEWESNGQPENNYKTTPPVLDSDGSFFLYSKLTVDKSRWQQGNVFSCSVMHEALHNHYT
QKSLSLSPGK*
```

OPP022: LC C225 3954-1204
Nucleotide Sequence
[spacer (SEQ ID NO: 507)][OPP022 without spacer (SEQ ID NO: 509)]
(SEQ ID NO: 449)
```
[CAAGGCCAGTCTGGCCAG][TGCATCTCACCTCGTGGTTGTCCGGACGGCCCATACGTCATGTACGGCTCGAGCGG
TGGCAGCGGTGGCTCTGGTGGATCCGGTCTGAGCGGCCGTTCCGATAATCATGGCAGTAGCGGTACCCAGATCTTGC
TGACCCAGAGCCCGGTGATTCTGAGCGTGAGCCCGGGCGAACGTGTGAGCTTTAGCTGCCGCGCGAGCCAGAGCATT
GGCACCAACATTCATTGGTATCAGCAGCGCACCAACGGCAGCCCGCGCCTGCTGATTAAATATGCGAGCGAAAGCAT
TAGCGGCATTCCGAGCCGCTTTAGCGGCAGCGGCAGCGGCACCGATTTTACCCTGAGCATTAACAGCGTGGAAAGCG
AAGATATTGCGGATTATTATTGCCAGCAGAACAACAACTGGCCGACCACCTTTGGCGCGGGCACCAAACTGGAACTG
AAACGTACGGTGGCTGCACCATCTGTCTTCATCTTCCCGCCATCTGATGAGCAGTTGAAATCTGGAACTGCCTCTGT
TGTGTGCCTGCTGAATAACTTCTATCCCAGAGAGGCCAAAGTACAGTGGAAGGTGGATAACGCCCTCCAATCGGGTA
ACTCCCAGGAGAGTGTCACAGAGCAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTGAGCTCGCCCGTCACAAAGAGCTT
CAACAGGGGAGAGTGTTAG]
```

Amino Acid Sequence
[spacer (SEQ ID NO: 87)][OPP022 without spacer (SEQ ID NO: 508)]
(SEQ ID NO: 450)
```
[QGQSGQ][CISPRGCPDGPYVMYGSSGGSGGSGGSGLSGRSDNHGSSGTQILLTQSPVILSVSPGERVSFSCRASQ
SIGTNIHWYQQRTNGSPRLLIKYASESISGIPSRFSGSGSGTDFTLSINSVESEDIADYYCQQNNNWPTTFGAGTKL
ELKRTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC]*
```

-continued

CI025: IL6RN297Q
pLW078: HC IL6RN297Q
Nucleotide Sequence
(SEQ ID NO: 465)
CAGGTGCAGCTGCAGGAGTCCGGACCAGGACTGGTCCGGCCCTCACAGACTCTGAGCCTGACATGCACTGTGTCAGG

CTACAGCATCACCTCCGATCACGCCTGGAGCTGGGTCAGGCAGCCACCTGGACGCGGCCTGGAATGGATCGGCTACA

TTTCTTATAGTGGGATCACCACATACAACCCCTCTCTGAAGAGTCGAGTGACCATTTCCAGAGACAACTCTAAAAAT

ACACTGTATCTGCAGATGAATAGTCTGCGGGCCGAGGATACAGCTGTGTACTATTGTGCACGGTCTCTGGCCAGAAC

TACCGCTATGGACTATTGGGGCAGGGAAGCCTGGTGACCGTCAGCTCCGCTAGCACCAAGGGCCCATCGGTCTTCC

CCCTGGCACCCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCCCTGACCAGCGGCGTGCACACCTTCCCGGCTGTCCTACAGTCCTCAGG

ACTCTACTCCCTCAGCAGCGTGGTGACCGTGCCCTCCAGCAGCTTGGGCACCCAGACCTACATCTGCAACGTGAATC

ACAAGCCCAGCAACACCAAGGTGGACAAGAAAGTTGAGCCCAAATCTTGTGACAAAACTCACACATGCCCACCGTGC

CCAGCACCTGAACTCCTGGGGGGACCGTCAGTCTTCCTCTTCCCCCCAAAACCCAAGGACACCCTCATGATCTCCCG

GACCCCTGAGGTCACATGCGTGGTGGTGGACGTGAGCCACGAAGACCCTGAGGTCAAGTTCAACTGGTACGTGGACG

GCGTGGAGGTGCATAATGCCAAGACAAAGCCGCGGGAGGAGCAGTACCAGAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCAT

CGAGAAAACCATCTCCAAAGCCAAAGGGCAGCCCCGAGAACCACAGGTGTACACCCTGCCCCCATCCCGGGAGGAGA

TGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAA

GCTCACCGTGGACAAGAGCAGGTGGCAGCAGGGGAACGTCTTCTCATGCTCCGTGATGCATGAGGCTCTGCACAACC

ACTACACGCAGAAGAGCCTCTCCCTGTCTCCGGGTAAATGA

Amino Acid Sequence
(SEQ ID NO: 466)
QVQLQESGPGLVRPSQTLSLTCTVSGYSITSDHAWSWVRQPPGRGLEWIGYISYSGITTYNPSLKSRVTISRDNSKN

TLYLQMNSLRAEDTAVYYCARSLARTTAMDYWGQGSLVTVSSASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLFPPKPKDTLMISRTPEVTCVVVDVSHEDPEVKFNWYVDGVEVHNAKTKPREEQYQSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSLSPGK* pLW077: LC IL6R
Nucleotide Sequence
(SEQ ID NO: 467)
GACATCCAGATGACTCAGTCTCCTAGCTCCCTGTCCGCCTCTGTGGGGGACCGAGTCACCATCACATGCAGAGCCAG

CCAGGATATTTCTAGTTACCTGAACTGGTATCAGCAGAAGCCCGGAAAAGCACCTAAGCTGCTGATCTACTATACCT

CCAGGCTGCACTCTGGCGTGCCCAGTCGGTTCAGTGGCTCAGGGAGCGGAACCGACTTCACTTTTACCATCTCAAGC

CTGCAGCCAGAGGATATTGCCACATACTATTGTCAGCAGGGCAATACACTGCCCTACACTTTTGGCCAGGGGACCAA

GGTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence (SEQ ID NO: 468)

DIQMTQSPSSLSASVGDRVTITCRASQDISSYLNWYQQKPGKAPKLLIYYTSRLHSGVPSRFSGSGSGTDFTFTISS

LQPEDIATYYCQQGNTLPYTFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI026: IL6RN297Q-CD3LvHv-H-N
pLW083: HC IL6RN297Q-CD3LvHv-H-N
Nucleotide Sequence (SEQ ID NO: 469)

CAGACCGTGGTCACACAGGAGCCCTCACTGACAGTGAGCCCTGGCGGGACCGTCACACTGACTTGTCGCAGTTCAAC

TGGCGCCGTGACTACCAGCAATTACGCTAACTGGGTCCAGCAGAAACCAGGACAGGCACCACGAGGACTGATCGGAG

GAACTAATAAGAGAGCACCAGGAACCCCTGCAAGGTTCTCCGGATCTCTGCTGGGGGGAAAAGCCGCTCTGACACTG

AGCGGCGTGCAGCCTGAGGACGAAGCTGAGTACTATTGCGCACTGTGGTACTCCAACCTGTGGGTGTTTGGCGGGGG

AACTAAGCTGACCGTCCTGGGAGGAGGAGGAAGCGGAGGAGGAGGGAGCGGAGGAGGAGGATCCGAAGTGCAGCTGG

TCGAGAGCGGAGGAGGACTGGTGCAGCCAGGAGGATCCCTGAAGCTGTCTTGTGCAGCCAGTGGCTTCACCTTCAAC

ACTTACGCAATGAACTGGGTGCGGCAGGCACCTGGGAAGGGACTGGAATGGGTCGCCCGGATCAGATCTAAATACAA

TAACTATGCCACCTACTATGCTGACAGTGTGAAGGATAGGTTCACCATTTCACGCGACGATAGCAAAAACACAGCTT

ATCTGCAGATGAATAACCTGAAGACCGAGGATACAGCAGTGTACTATTGCGTCAGACACGGCAATTTCGGGAACTCT

TACGTGAGTTGGTTTGCCTATTGGGGACAGGGGACACTGGTCACCGTCTCCTCAGGAGGTGGTGGATCCCAGGTGCA

GCTGCAGGAGTCCGGACCAGGACTGGTCCGGCCCTCACAGACTCTGAGCCTGACATGCACTGTGTCAGGCTACAGCA

TCACCTCCGATCACGCCTGGAGCTGGGTCAGGCAGCCACCTGGACGCGGCCTGGAATGGATCGGCTACATTTCTTAT

AGTGGGATCACCACATACAACCCCTCTCTGAAGAGTCGAGTGACCATTTCCAGAGACAACTCTAAAAATACACTGTA

TCTGCAGATGAATAGTCTGCGGGCCGAGGATACAGCTGTGTACTATTGTGCACGGTCTCTGGCCAGAACTACCGCTA

TGGACTATTGGGGCAGGGAAGCCTGGTGACCGTCAGCTCCGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA

Amino Acid Sequence (SEQ ID NO: 470)

QTVVTQEPSLTVSPGGTVTLTCRSSTGAVTTSNYANWVQQKPGQAPRGLIGGTNKRAPGTPARFSGSLLGGKAALTL

SGVQPEDEAEYYCALWYSNLWVFGGGTKLTVLGGGGSGGGGSGGGGSEVQLVESGGGLVQPGGSLKLSCAASGFTFN

TYAMNWVRQAPGKGLEWVARIRSKYNNYATYYADSVKDRFTISRDDSKNTAYLQMNNLKTEDTAVYYCVRHGNFGNS

YVSWFAYWGQGTLVTVSSGGGGSQVQLQESGPGLVRPSQTLSLTCTVSGYSITSDHAWSWVRQPPGRGLEWIGYISY

SGITTYNPSLKSRVTISRDNSKNTLYLQMNSLRAEDTAVYYCARSLARTTAMDYWGQGSLVTVSSASTKGPSVFPLA

-continued

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK* pLW077: LC IL6R
Nucleotide Sequence
(SEQ ID NO: 467)
GACATCCAGATGACTCAGTCTCCTAGCTCCCTGTCCGCCTCTGTGGGGGACCGAGTCACCATCACATGCAGAGCCAG

CCAGGATATTTCTAGTTACCTGAACTGGTATCAGCAGAAGCCCGGAAAAGCACCTAAGCTGCTGATCTACTATACCT

CCAGGCTGCACTCTGGCGTGCCCAGTCGGTTCAGTGGCTCAGGGAGCGGAACCGACTTCACTTTTACCATCTCAAGC

CTGCAGCCAGAGGATATTGCCACATACTATTGTCAGCAGGGCAATACACTGCCCTACACTTTTGGCCAGGGGACCAA

GGTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence
(SEQ ID NO: 468)
DIQMTQSPSSLSASVGDRVTITCRASQDISSYLNWYQQKPGKAPKLLIYYTSRLHSGVPSRFSGSGSGTDFTFTISS

LQPEDIATYYCQQGNTLPYTFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI027: IL6RN297Q-15865 1204-CD3LvHv-H-N
pLW085: HC IL6RN297Q-15865_1204-CD3LvHv-H-N
Nucleotide Sequence
[spacer (SEQ ID NO: 507)][pLW085 without spacer (SEQ ID NO: 513)]
(SEQ ID NO: 471)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGCAGGAGTCCGGACCA

GGACTGGTCCGGCCCTCACAGACTCTGAGCCTGACATGCACTGTGTCAGGCTACAGCATCACCTCCGATCACGCCTG

GAGCTGGGTCAGGCAGCCACCTGGACGCGGCCTGGAATGGATCGGCTACATTTCTTATAGTGGGATCACCACATACA

ACCCCTCTCTGAAGAGTCGAGTGACCATTTCCAGAGACAACTCTAAAAATACACTGTATCTGCAGATGAATAGTCTG

CGGGCCGAGGATACAGCTGTGTACTATTGTGCACGGTCTCTGGCCAGAACTACCGCTATGGACTATTGGGGCAGGG

AAGCCTGGTGACCGTCAGCTCCGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

-continued

```
CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]
```

Amino Acid Sequence
[spacer (SEQ ID NO: 87)][pLW085 without spacer (SEQ ID NO: 514)]
(SEQ ID NO: 472)
[QGQSGQ][MMYCGGNEVLCGPRVGSSGGSGGSGGLSGRSDNHGGGSQTVVTQEPSLTVSPGGTVTLTCRSSTGAVT

TSNYANWVQQKPGQAPRGLIGGTNKRAPGTPARFSGSLLGGKAALTLSGVQPEDEAEYYCALWYSNLWVFGGGTKLT

VLGGGGSGGGGSGGGGSEVQLVESGGGLVQPGGSLKLSCAASGFTFNTYAMNWVRQAPGKGLEWVARIRSKYNNYAT

YYADSVKDRFTISRDDSKNTAYLQMNNLKTEDTAVYYCVRHGNFGNSYVSWFAYWGQGTLVTVSSGGGGSQVQLQES

GPGLVRPSQTLSLTCTVSGYSITSDHAWSWVRQPPGRGLEWIGYISYSGITTYNPSLKSRVTISRDNSKNTLYLQMN

SLRAEDTAVYYCARSLARTTAMDYWGQGSLVTVSSASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]* pLW077: LC IL6R
Nucleotide Sequence
(SEQ ID NO: 467)
```
GACATCCAGATGACTCAGTCTCCTAGCTCCCTGTCCGCCTCTGTGGGGGACCGAGTCACCATCACATGCAGAGCCAG

CCAGGATATTTCTAGTTACCTGAACTGGTATCAGCAGAAGCCCGGAAAAGCACCTAAGCTGCTGATCTACTATACCT

CCAGGCTGCACTCTGGCGTGCCCAGTCGGTTCAGTGGCTCAGGGAGCGGAACCGACTTCACTTTTACCATCTCAAGC

CTGCAGCCAGAGGATATTGCCACATACTATTGTCAGCAGGGCAATACACTGCCCTACACTTTTGGCCAGGGGACCAA

GGTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG
```

Amino Acid Sequence
(SEQ ID NO: 468)
DIQMTQSPSSLSASVGDRVTITCRASQDISSYLNWYQQKPGKAPKLLIYYTSRLHSGVPSRFSGSGSGTDFTFTISS

LQPEDIATYYCQQGNTLPYTFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI029: 4792-1204-1L6RN297Q-15865_1204-CD3LvHv-H-N
pLW085: HC IL6RN297Q-15865_1204-CD3LvHv-H-N
Nucleotide Sequence
[spacer (SEQ ID NO: 507)][pLW085 without spacer (SEQ ID NO: 513)]

(SEQ ID NO: 471)

[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGCAGGAGTCCGGACCA

GGACTGGTCCGGCCCTCACAGACTCTGAGCCTGACATGCACTGTGTCAGGCTACAGCATCACCTCCGATCACGCCTG

GAGCTGGGTCAGGCAGCCACCTGGACGCGGCCTGGAATGGATCGGCTACATTTCTTATAGTGGGATCACCACATACA

ACCCCTCTCTGAAGAGTCGAGTGACCATTTCCAGAGACAACTCTAAAAATACACTGTATCTGCAGATGAATAGTCTG

CGGGCCGAGGATACAGCTGTGTACTATTGTGCACGGTCTCTGGCCAGAACTACCGCTATGGACTATTGGGGCAGGG

AAGCCTGGTGACCGTCAGCTCCGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

Amino Acid Sequence
[spacer (SEQ ID NO: 87)][pLW085 without spacer (SEQ ID NO: 514)]

(SEQ ID NO: 472)

[QGQSGQ][MMYCGGNEVLCGPRVGSSGGSGGSGGLSGRSDNHGGGSQTVVTQEPSLTVSPGGTVTLTCRSSTGAVT

TSNYANWVQQKPGQAPRGLIGGTNKRAPGTPARFSGSLLGGKAALTLSGVQPEDEAEYYCALWYSNLWVFGGGTKLT

VLGGGGSGGGGSGGGGSEVQLVESGGGLVQPGGSLKLSCAASGFTFNTYAMNWVRQAPGKGLEWVARIRSKYNNYAT

YYADSVKDRFTISRDDSKNTAYLQMNNLKTEDTAVYYCVRHGNFGNSYVSWFAYWGQGTLVTVSSGGGGSQVQLQES

GPGLVRPSQTLSLTCTVSGYSITSDHAWSWVRQPPGRGLEWIGYISYSGITTYNPSLKSRVTISRDNSKNTLYLQMN

SLRAEDTAVYYCARSLARTTAMDYWGQGSLVTVSSASTKGPSVFPLAPSSKSTSGGTAALGCLVKDYFPEPVTVSWN

-continued

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]* pLW080: LC IL6R 4792 1204
Nucleotide Sequence
[spacer (SEQ ID NO: 507)][pLW080 without spacer (SEQ ID NO: 515)]

(SEQ ID NO: 473)

[CAAGGCCAGTCTGGCCAG][TATGGGTCCTGCAGTTGGAACTATGTACACATATTCATGGATTGCGGCTCGAGCGG

TGGCAGCGGTGGCTCTGGTGGTCTGAGCGGCCGTTCCGATAATCATGGCGGCGGTTCTGACATCCAGATGACTCAGT

CTCCTAGCTCCCTGTCCGCCTCTGTGGGGGACCGAGTCACCATCACATGCAGAGCCAGCCAGGATATTTCTAGTTAC

CTGAACTGGTATCAGCAGAAGCCCGGAAAAGCACCTAAGCTGCTGATCTACTATACCTCCAGGCTGCACTCTGGCGT

GCCCAGTCGGTTCAGTGGCTCAGGGAGCGGAACCGACTTCACTTTTACCATCTCAAGCCTGCAGCCAGAGGATATTG

CCACATACTATTGTCAGCAGGGCAATACACTGCCCTACACTTTTGGCCAGGGGACCAAGGTGGAAATCAAACGTACG

GTGGCTGCACCATCTGTCTTCATCTTCCCGCCATCTGATGAGCAGTTGAAATCTGGAACTGCCTCTGTTGTGTGCCT

GCTGAATAACTTCTATCCCAGAGAGGCCAAAGTACAGTGGAAGGTGGATAACGCCCTCCAATCGGGTAACTCCCAGG

AGAGTGTCACAGAGCAGGACAGCAAGGACAGCACCTACAGCCTCAGCAGCACCCTGACGCTGAGCAAAGCAGACTAC

GAGAAACACAAAGTCTACGCCTGCGAAGTCACCCATCAGGGCCTGAGCTCGCCCGTCACAAAGAGCTTCAACAGGGG

AGAGTGTTAG]

Amino Acid Sequence
[spacer (SEQ ID NO: 87)][pLW080 without spacer (SEQ ID NO: 516)]

(SEQ ID NO: 474)

[QGQSGQ][YGSCSWNYVHIFMDCGSSGGSGGSGGLSGRSDNHGGGSDIQMTQSPSSLSASVGDRVTITCRASQDIS

SYLNWYQQKPGKAPKLLIYYTSRLHSGVPSRFSGSGSGTDFTFTISSLQPEDIATYYCQQGNTLPYTFGQGTKVEIK

RTVAAPSVFIFPPSDEQLKSGTASVVCLLNNFYPREAKVQWKVDNALQSGNSQESVTEQDSKDSTYSLSSTLTLSKA

DYEKHKVYACEVTHQGLSSPVTKSFNRGEC]*

CI036: 4792-1204-IL6RN297Q-CD3LvHv-H-N
pLW083: HC AV1N297Q-CD3LvHv-H-N
Nucleotide Sequence (SEQ ID NO: 469)

CAGACCGTGGTCACACAGGAGCCCTCACTGACAGTGAGCCCTGGCGGGACCGTCACACTGACTTGTCGCAGTTCAAC

TGGCGCCGTGACTACCAGCAATTACGCTAACTGGGTCCAGCAGAAACCAGGACAGGCACCACGAGGACTGATCGGAG

GAACTAATAAGAGAGCACCAGGAACCCCTGCAAGGTTCTCCGGATCTCTGCTGGGGGAAAAGCCGCTCTGACACTG

AGCGGCGTGCAGCCTGAGGACGAAGCTGAGTACTATTGCGCACTGTGGTACTCCAACCTGTGGGTGTTTGGCGGGGG

AACTAAGCTGACCGTCCTGGGAGGAGGAGGAAGCGGAGGAGGAGGGAGCGGAGGAGGAGGATCCGAAGTGCAGCTGG

TCGAGAGCGGAGGAGGACTGGTGCAGCCAGGAGGATCCCTGAAGCTGTCTTGTGCAGCCAGTGGCTTCACCTTCAAC

ACTTACGCAATGAACTGGGTGCGGCAGGCACCTGGGAAGGGACTGGAATGGGTCGCCCGGATCAGATCTAAATACAA

TAACTATGCCACCTACTATGCTGACAGTGTGAAGGATAGGTTCACCATTTCACGCGACGATAGCAAAAACACAGCTT

ATCTGCAGATGAATAACCTGAAGACCGAGGATACAGCAGTGTACTATTGCGTCAGACACGGCAATTTCGGGAACTCT

TACGTGAGTTGGTTTGCCTATTGGGGACAGGGGACACTGGTCACCGTCTCCTCAGGAGGTGGTGGATCCCAGGTGCA

GCTGCAGGAGTCCGGACCAGGACTGGTCCGGCCCTCACAGACTCTGAGCCTGACATGCACTGTGTCAGGCTACAGCA

TCACCTCCGATCACGCCTGGAGCTGGGTCAGGCAGCCACCTGGACGCGGCCTGGAATGGATCGGCTACATTTCTTAT

AGTGGGATCACCACATACAACCCCTCTCTGAAGAGTCGAGTGACCATTTCCAGAGACAACTCTAAAAATACACTGTA

TCTGCAGATGAATAGTCTGCGGGCCGAGGATACAGCTGTGTACTATTGTGCACGGTCTCTGGCCAGAACTACCGCTA

TGGACTATTGGGGCAGGGAAGCCTGGTGACCGTCAGCTCCGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

-continued

```
GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA

Amino Acid Sequence
                                                            (SEQ ID NO: 470)
QTVVTQEPSLTVSPGGTVTLTCRSSTGAVTTSNYANWVQQKPGQAPRGLIGGTNKRAPGTPARFSGSLLGGKAALTL

SGVQPEDEAEYYCALWYSNLWVFGGGTKLTVLGGGGSGGGGSGGGGSEVQLVESGGGLVQPGGSLKLSCAASGFTFN

TYAMNWVRQAPGKGLEWVARIRSKYNNYATYYADSVKDRFTISRDDSKNTAYLQMNNLKTEDTAVYYCVRHGNFGNS

YVSWFAYWGQGTLVTVSSGGGGSQVQLQESGPGLVRPSQTLSLTCTVSGYSITSDHAWSWVRQPPGRGLEWIGYISY

SGITTYNPSLKSRVTISRDNSKNTLYLQMNSLRAEDTAVYYCARSLARTTAMDYWGQGSLVTVSSASTKGPSVFPLA

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK* pLW080: LC IL6R 4792 1204
Nucleotide Sequence
[spacer (SEQ ID NO: 507)][pLW080 without spacer (SEQ ID NO: 515)]
                                                            (SEQ ID NO: 473)
[CAAGGCCAGTCTGGCCAG][TATGGGTCCTGCAGTTGGAACTATGTACACATATTCATGGATTGCGGCTCGAGCGG

TGGCAGCGGTGGCTCTGGTGGTCTGAGCGGCCGTTCCGATAATCATGGCGGCGGTTCTGACATCCAGATGACTCAGT

CTCCTAGCTCCCTGTCCGCCTCTGTGGGGGACCGAGTCACCATCACATGCAGAGCCAGCCAGGATATTTCTAGTTAC

CTGAACTGGTATCAGCAGAAGCCCGGAAAAGCACCTAAGCTGCTGATCTACTATACCTCCAGGCTGCACTCTGGCGT

GCCCAGTCGGTTCAGTGGCTCAGGGAGCGGAACCGACTTCACTTTTACCATCTCAAGCCTGCAGCCAGAGGATATTG

CCACATACTATTGTCAGCAGGGCAATACACTGCCCTACACTTTTGGCCAGGGGACCAAGGTGGAAATCAAACGTACG

GTGGCTGCACCATCTGTCTTCATCTTCCCGCCATCTGATGAGCAGTTGAAATCTGGAACTGCCTCTGTTGTGTGCCT

GCTGAATAACTTCTATCCCAGAGAGGCCAAAGTACAGTGGAAGGTGGATAACGCCCTCCAATCGGGTAACTCCCAGG

AGAGTGTCACAGAGCAGGACAGCAAGGACAGCACCTACAGCCTCAGCAGCACCCTGACGCTGAGCAAAGCAGACTAC

GAGAAACACAAAGTCTACGCCTGCGAAGTCACCCATCAGGGCCTGAGCTCGCCCGTCACAAAGAGCTTCAACAGGGG

AGAGTGTTAG]

Amino Acid Sequence
[spacer (SEQ ID NO: 87)][pLW080 without spacer (SEQ ID NO: 516)]
                                                            (SEQ ID NO: 474)
[QGQSGQ][YGSCSWNYVHIFMDCGSSGGSGGSGGLSGRSDNHGGGSDIQMTQSPSSLSASVGDRVTITCRASQDIS SYLNWYQQKPGKAPKLLIYYTSRLHSGVPSRFSGSGSGTDFTFTISSLQPEDIATYYCQQGNTLPYTFGQGTKVEIK
```

RTVAAPSVFIFPPSDEQLKSGTASVVCLLNNFYPREAKVQWKVDNALQSGNSQESVTEQDSKDSTYSLSSTLTLSKA

DYEKHKVYACEVTHQGLSSPVTKSFNRGEC]*

CI039: 3954-2001-C225v5 N297Q-15865-2001-CD3LvHv-H-N
pLW101: HC C225v5N297Q-15865-2001-CD3LvHv-H-N
Nucleotide Sequence
[spacer (SEQ ID NO: 507)][pLW101 without spacer (SEQ ID NO: 517)]
(SEQ ID NO: 479)

[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTATCTCTTCCGGACTGCTGTCCGGCAGATCCGACAATCACGGCGGCGGTTCTCAGA

CCGTGGTCACACAGGAGCCCTCACTGACAGTGAGCCCTGGCGGGACCGTCACACTGACTTGTCGCAGTTCAACTGGC

GCCGTGACTACCAGCAATTACGCTAACTGGGTCCAGCAGAAACCAGGACAGGCACCACGAGGACTGATCGGAGGAAC

TAATAAGAGAGCACCAGGAACCCCTGCAAGGTTCTCCGGATCTCTGCTGGGGGGAAAAGCCGCTCTGACACTGAGCG

GCGTGCAGCCTGAGGACGAAGCTGAGTACTATTGCGCACTGTGGTACTCCAACCTGTGGGTGTTTGGCGGGGAACT

AAGCTGACCGTCCTGGGAGGAGGAGGAAGCGGAGGAGGAGGGAGCGGAGGAGGAGGATCCGAAGTGCAGCTGGTCGA

GAGCGGAGGAGGACTGGTGCAGCCAGGAGGATCCCTGAAGCTGTCTTGTGCAGCCAGTGGCTTCACCTTCAACACTT

ACGCAATGAACTGGGTGCGGCAGGCACCTGGGAAGGGACTGGAATGGGTCGCCCGGATCAGATCTAAATACAATAAC

TATGCCACCTACTATGCTGACAGTGTGAAGGATAGGTTCACCATTTCACGCGACGATAGCAAAAACACAGCTTATCT

GCAGATGAATAACCTGAAGACCGAGGATACAGCAGTGTACTATTGCGTCAGACACGGCAATTTCGGGAACTCTTACG

TGAGTTGGTTTGCCTATTGGGGACAGGGGACACTGGTCACCGTCTCCTCAGGAGGTGGTGGATCCCAGGTGCAGCTG

AAACAGAGCGGCCCGGGCCTGGTGCAGCCGAGCCAGAGCCTGAGCATTACCTGCACCGTGAGCGGCTTTAGCCTGAC

CAACTATGGCGTGCATTGGGTGCGCCAGAGCCCGGGCAAAGGCCTGGAATGGCTGGGCGTGATTTGGAGCGGCGGCA

ACACCGATTATAACACCCCGTTTACCAGCCGCCTGAGCATTAACAAAGATAACAGCAAAAGCCAGGTGTTTTTTAAA

ATGAACAGCCTGCAAAGCCAGGATACCGCGATTTATTATTGCGCGCGCGCGCTGACCTATTATGATTATGAATTTGC

GTATTGGGGCCAGGGCACCCTGGTGACCGTGAGCGCGGCTAGCACCAAGGGCCCATCGGTCTTCCCCCTGGCACCCT

CCTCCAAGAGCACCTCTGGGGGCACAGCGGCCCTGGGCTGCCTGGTCAAGGACTACTTCCCCGAACCGGTGACGGTG

TCGTGGAACTCAGGCGCCCTGACCAGCGGCGTGCACACCTTCCCGGCTGTCCTACAGTCCTCAGGACTCTACTCCCT

CAGCAGCGTGGTGACCGTGCCCTCCAGCAGCTTGGGCACCCAGACCTACATCTGCAACGTGAATCACAAGCCCAGCA

ACACCAAGGTGGACAAGAAAGTTGAGCCCAAATCTTGTGACAAAACTCACACATGCCCACCGTGCCCAGCACCTGAA

CTCCTGGGGGGACCGTCAGTCTTCCTCTTCCCCCCAAAACCCAAGGACACCCTCATGATCTCCCGGACCCCTGAGGT

CACATGCGTGGTGGTGGACGTGAGCCACGAAGACCCTGAGGTCAAGTTCAACTGGTACGTGGACGGCGTGGAGGTGC

ATAATGCCAAGACAAAGCCGCGGGAGGAGCAGTACCAGAGCACGTACCGTGTGGTCAGCGTCCTCACCGTCCTGCAC

CAGGACTGGCTGAATGGCAAGGAGTACAAGTGCAAGGTCTCCAACAAAGCCCTCCCAGCCCCCATCGAGAAAACCAT

CTCCAAAGCCAAAGGGCAGCCCCGAGAACCACAGGTGTACACCCTGCCCCCATCCCGGGAGGAGATGACCAAGAACC

AGGTCAGCCTGACCTGCCTGGTCAAAGGCTTCTATCCCAGCGACATCGCCGTGGAGTGGGAGAGCAATGGGCAGCCG

GAGAACAACTACAAGACCACGCCTCCCGTGCTGGACTCCGACGGCTCCTTCTTCCTCTACAGCAAGCTCACCGTGGA

CAAGAGCAGGTGGCAGCAGGGGAACGTCTTCTCATGCTCCGTGATGCATGAGGCTCTGCACAACCACTACACGCAGA

AGAGCCTCTCCCTGTCTCCGGGTAAATGA]

Amino Acid Sequence
[spacer (SEQ ID NO: 87)][pLW101 without spacer (SEQ ID NO: 518)]
(SEQ ID NO: 480)

[QGQSGQ][MMYCGGNEVLCGPRVGSSGGSGGSGGISSGLLSGRSDNHGGGSQTVVTQEPSLTVSPGGTVTLTCRSS

TGAVTTSNYANWVQQKPGQAPRGLIGGTNKRAPGTPARFSGSLLGGKAALTLSGVQPEDEAEYYCALWYSNLWVFGG

GTKLTVLGGGGSGGGGSGGGGSEVQLVESGGGLVQPGGSLKLSCAASGFTFNTYAMNWVRQAPGKGLEWVARIRSKY

NNYATYYADSVKDRFTISRDDSKNTAYLQMNNLKTEDTAVYYCVRHGNFGNSYVSWFAYWGQGTLVTVSSGGGGSQV

-continued

QLKQSGPGLVQPSQSLSITCTVSGFSLTNYGVHWVRQSPGKGLEWLGVIWSGGNTDYNTPFTSRLSINKDNSKSQVF

FKMNSLQSQDTAIYYCARALTYYDYEFAYWGQGTLVTVSAASTKGPSVFPLAPSSKSTSGGTAALGCLVKDYFPEPV

TVSWNSGALTSGVHTFPAVLQSSGLYSLSSVVTVPSSSLGTQTYICNVNHKPSNTKVDKKVEPKSCDKTHTCPPCPA

PELLGGPSVFLFPPKPKDTLMISRTPEVTCVVVDVSHEDPEVKFNWYVDGVEVHNAKTKPREEQYQSTYRVVSVLTV

LHQDWLNGKEYKCKVSNKALPAPIEKTISKAKGQPREPQVYTLPPSREEMTKNQVSLTCLVKGFYPSDIAVEWESNG

QPENNYKTTPPVLDSDGSFFLYSKLTVDKSRWQQGNVFSCSVMHEALHNHYTQKSLSLSPGK]*

LC C225-3954-2001
Nucleotide Sequence
[spacer (SEQ ID NO: 507)][3954-2001-C225v5 without spacer (SEQ ID NO: 519)]
(SEQ ID NO: 481)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTATTAGCAGTGGTCTGTTAAGCGGTCGTAGCGATAATCATGGCAGTAGCG

GTACCCAGATCTTGCTGACCCAGAGCCCGGTGATTCTGAGCGTGAGCCCGGGCGAACGTGTGAGCTTTAGCTGCCGC

GCGAGCCAGAGCATTGGCACCAACATTCATTGGTATCAGCAGCGCACCAACGGCAGCCCGCGCCTGCTGATTAAATA

TGCGAGCGAAAGCATTAGCGGCATTCCGAGCCGCTTTAGCGGCAGCGGCAGCGGCACCGATTTTACCCTGAGCATTA

ACAGCGTGGAAAGCGAAGATATTGCGGATTATTATTGCCAGCAGAACAACAACTGGCCGACCACCTTTGGCGCGGGC

ACCAAACTGGAACTGAAACGTACGGTGGCTGCACCATCTGTCTTCATCTTCCCGCCATCTGATGAGCAGTTGAAATC

TGGAACTGCCTCTGTTGTGTGCCTGCTGAATAACTTCTATCCCAGAGAGGCCAAAGTACAGTGGAAGGTGGATAACG

CCCTCCAATCGGGTAACTCCCAGGAGAGTGTCACAGAGCAGGACAGCAAGGACAGCACCTACAGCCTCAGCAGCACC

CTGACGCTGAGCAAAGCAGACTACGAGAAACACAAAGTCTACGCCTGCGAAGTCACCCATCAGGGCCTGAGCTCGCC

CGTCACAAAGAGCTTCAACAGGGGAGAGTGTTAG]

Amino Acid Sequence
[spacer (SEQ ID NO: 87)][pLW080 without spacer (SEQ ID NO: 520)]
(SEQ ID NO: 482)
[QGQSGQ][CISPRGCPDGPYVMYGSSGGSGGSGGSGISSGLLSGRSDNHGSSGTQILLTQSPVILSVSPGERVSFS

CRASQSIGTNIHWYQQRTNGSPRLLIKYASESISGIPSRFSGSGSGTDFTLSINSVESEDIADYYCQQNNNWPTTFG

AGTKLELKRTVAAPSVFIFPPSDEQLKSGTASVVCLLNNFYPREAKVQWKVDNALQSGNSQESVTEQDSKDSTYSLS

STLTLSKADYEKHKVYACEVTHQGLSSPVTKSFNRGEC]*

CI040: 3954-2001-C225v5 N297Q-CD3LvHv-H-N
pLW057: HC C225v5N297Q-CD3LvHv-H-N
Nucleotide Sequence
(SEQ ID NO: 479)
CAGACCGTGGTCACACAGGAGCCCTCACTGACAGTGAGCCCTGGCGGGACCGTCACACTGACTTGTCGCAGTTCAAC

TGGCGCCGTGACTACCAGCAATTACGCTAACTGGGTCCAGCAGAAACCAGGACAGGCACCACGAGGACTGATCGGAG

GAACTAATAAGAGAGCACCAGGAACCCCTGCAAGGTTCTCCGGATCTCTGCTGGGGGAAAAGCCGCTCTGACACTG

AGCGGCGTGCAGCCTGAGGACGAAGCTGAGTACTATTGCGCACTGTGGTACTCCAACCTGTGGGTGTTTGGCGGGGG

AACTAAGCTGACCGTCCTGGGAGGAGGAGGAAGCGGAGGAGGAGGGAGCGGAGGAGGAGGATCCGAAGTGCAGCTGG

TCGAGAGCGGAGGAGGACTGGTGCAGCCAGGAGGATCCCTGAAGCTGTCTTGTGCAGCCAGTGGCTTCACCTTCAAC

ACTTACGCAATGAACTGGGTGCGGCAGGCACCTGGGAAGGGACTGGAATGGGTCGCCCGGATCAGATCTAAATACAA

TAACTATGCCACCTACTATGCTGACAGTGTGAAGGATAGGTTCACCATTTCACGCGACGATAGCAAAAACACAGCTT

ATCTGCAGATGAATAACCTGAAGACCGAGGATACAGCAGTGTACTATTGCGTCAGACACGGCAATTTCGGGAACTCT

TACGTGAGTTGGTTTGCCTATTGGGGACAGGGGACACTGGTCACCGTCTCCTCAGGAGGTGGTGGATCCCAGGTGCA

GCTGAAACAGAGCGGCCCGGGCCTGGTGCAGCCGAGCCAGAGCCTGAGCATTACCTGCACCGTGAGCGGCTTTAGCC

TGACCAACTATGGCGTGCATTGGGTGCGCCAGAGCCCGGGCAAAGGCCTGGAATGGCTGGGCGTGATTTGGAGCGGC

GGCAACACCGATTATAACACCCCGTTTACCAGCCGCCTGAGCATTAACAAAGATAACAGCAAAAGCCAGGTGTTTTT

TAAAATGAACAGCCTGCAAAGCCAGGATACCGCGATTTATTATTGCGCGCGCGCGCTGACCTATTATGATTATGAAT

-continued

```
TTGCGTATTGGGGCCAGGGCACCCTGGTGACCGTGAGCGCGGCTAGCACCAAGGGCCCATCGGTCTTCCCCCTGGCA

CCCTCCTCCAAGAGCACCTCTGGGGGCACAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAATCACAAGCCC

AGCAACACCAAGGTGGACAAGAAAGTTGAGCCCAAATCTTGTGACAAAACTCACACATGCCCACCGTGCCCAGCACC

TGAACTCCTGGGGGGACCGTCAGTCTTCCTCTTCCCCCCAAAACCCAAGGACACCCTCATGATCTCCCGGACCCCTG

AGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACCAGAGCACGTACCGTGTGGTCAGCGTCCTCACCGTCCT

GCACCAGGACTGGCTGAATGGCAAGGAGTACAAGTGCAAGGTCTCCAACAAAGCCCTCCCAGCCCCCATCGAGAAAA

CCATCTCCAAAGCCAAAGGGCAGCCCCGAGAACCACAGGTGTACACCCTGCCCCCATCCCGGGAGGAGATGACCAAG

AACCAGGTCAGCCTGACCTGCCTGGTCAAAGGCTTCTATCCCAGCGACATCGCCGTGGAGTGGGAGAGCAATGGGCA

GCCGGAGAACAACTACAAGACCACGCCTCCCGTGCTGGACTCCGACGGCTCCTTCTTCCTCTACAGCAAGCTCACCG

TGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGTAAATGA
```

Amino Acid Sequence
(SEQ ID NO: 480)

```
QTVVTQEPSLTVSPGGTVTLTCRSSTGAVTTSNYANWVQQKPGQAPRGLIGGTNKRAPGTPARFSGSLLGGKAALTL

SGVQPEDEAEYYCALWYSNLWVFGGGTKLTVLGGGGSGGGGSGGGGSEVQLVESGGGLVQPGGSLKLSCAASGFTFN

TYAMNWVRQAPGKGLEWVARIRSKYNNYATYYADSVKDRFTISRDDSKNTAYLQMNNLKTEDTAVYYCVRHGNFGNS

YVSWFAYWGQGTLVTVSSGGGGSQVQLKQSGPGLVQPSQSLSITCTVSGFSLTNYGVHWVRQSPGKGLEWLGVIWSG

GNTDYNTPFTSRLSINKDNSKSQVFFKMNSLQSDTAIYYCARALTYYDYEFAYWGQGTLVTVSAASTKGPSVFPLA

PSSKSTSGGTAALGCLVKDYFPEPVTVSWNSGALTSGVHTFPAVLQSSGLYSLSSVVTVPSSSLGTQTYICNVNHKP

SNTKVDKKVEPKSCDKTHTCPPCPAPELLGGPSVFLFPPKPKDTLMISRTPEVTCVVVDVSHEDPEVKFNWYVDGVE

VHNAKTKPREEQYQSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALHNHYT

QKSLSLSPGK*
```

LC C225-3954-2001
Nucleotide Sequence
[spacer (SEQ ID NO: 507)][3954-2001-C225v5without spacer (SEQ ID NO: 519)]
(SEQ ID NO: 481)

```
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTATTAGCAGTGGTCTGTTAAGCGGTCGTAGCGATAATCATGGCAGTAGCG

GTACCCAGATCTTGCTGACCCAGAGCCCGGTGATTCTGAGCGTGAGCCCGGGCGAACGTGTGAGCTTTAGCTGCCGC

GCGAGCCAGAGCATTGGCACCAACATTCATTGGTATCAGCAGCGCACCAACGGCAGCCCGCGCCTGCTGATTAAATA

TGCGAGCGAAAGCATTAGCGGCATTCCGAGCCGCTTTAGCGGCAGCGGCAGCGGCACCGATTTTACCCTGAGCATTA

ACAGCGTGGAAAGCGAAGATATTGCGGATTATTATTGCCAGCAGAACAACAACTGGCCGACCACCTTTGGCGCGGGC

ACCAAACTGGAACTGAAACGTACGGTGGCTGCACCATCTGTCTTCATCTTCCCGCCATCTGATGAGCAGTTGAAATC

TGGAACTGCCTCTGTTGTGTGCCTGCTGAATAACTTCTATCCCAGAGAGGCCAAAGTACAGTGGAAGGTGGATAACG

CCCTCCAATCGGGTAACTCCCAGGAGAGTGTCACAGAGCAGGACAGCAAGGACAGCACCTACAGCCTCAGCAGCACC

CTGACGCTGAGCAAAGCAGACTACGAGAAACACAAAGTCTACGCCTGCGAAGTCACCCATCAGGGCCTGAGCTCGCC

CGTCACAAAGAGCTTCAACAGGGGAGAGTGTTAG]
```

Amino Acid Sequence
[spacer (SEQ ID NO: 87)][pLW080 without spacer (SEQ ID NO: 520)]

(SEQ ID NO: 482)

[QGQSGQ][CISPRGCPDGPYVMYGSSGGSGGSGGSGISSGLLSGRSDNHGSSGTQILLTQSPVILSVSPGERVSFS

CRASQSIGTNIHWYQQRTNGSPRLLIKYASESISGIPSRFSGSGSGTDFTLSINSVESEDIADYYCQQNNNWPTTFG

AGTKLELKRTVAAPSVFIFPPSDEQLKSGTASVVCLLNNFYPREAKVQWKVDNALQSGNSQESVTEQDSKDSTYSLS

STLTLSKADYEKHKVYACEVTHQGLSSPVTKSFNRGEC]*

CI021: C225v5N297Q-15003-CD3HvLv-H-N
pLW047: HC C225v5N297Q-15003-CD3HvLv-H-N
Nucleotide Sequence
[spacer (SEQ ID NO: 507)][pLW047 without spacer (SEQ ID NO: 522)]

(SEQ ID NO: 461)

[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTGAGGTGCAGCTGGTCGAGT

CTGGAGGAGGATTGGTGCAGCCTGGAGGGTCATTGAAACTCTCATGTGCAGCCTCTGGATTCACCTTCAATAAGTAC

GCCATGAACTGGGTCCGCCAGGCTCCAGGAAAGGGTTTGGAATGGGTTGCTCGCATAAGAAGTAAATATAATAATTA

TGCAACATATTATGCCGATTCAGTGAAAGACAGGTTCACCATCTCCAGAGATGATTCAAAAAACACTGCCTATCTAC

AAATGAACAACTTGAAAACTGAGGACACTGCCGTGTACTACTGTGTGAGACATGGGAACTTCGGTAATAGCTACATA

TCCTACTGGGCTTACTGGGGCCAAGGGACTCTGGTCACCGTCTCCTCAGGTGGTGGTGGTTCTGGCGGCGGCGGCTC

CGGTGGTGGTGGTTCTCAGACTGTTGTGACTCAGGAACCTTCACTCACCGTATCACCTGGTGGAACAGTCACACTCA

CTTGTGGCTCCTCGACTGGGGCTGTTACATCTGGCTACTACCCAAACTGGGTCCAACAAAAACCAGGTCAGGCACCC

CGTGGTCTAATAGGTGGGACTAAGTTCCTCGCCCCCGGTACTCCTGCCAGATTCTCAGGCTCCCTGCTTGGAGGCAA

GGCTGCCCTCACCCTCTCAGGGGTACAGCCAGAGGATGAGGCAGAATATTACTGTGCTCTATGGTACAGCAACCGCT

GGGTGTTCGGTGGAGGAACCAAACTGACTGTCCTAGGAGGTGGTGGATCCCAGGTGCAGCTGAAACAGAGCGGCCCG

GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

-continued

```
Amino Acid Sequence
[spacer (SEQ ID NO: 87)][pLW047 without spacer (SEQ ID NO: 524)]
                                                             (SEQ ID NO: 462)
[QGQSGQ][GYRWGCEWNCGGITTGSSGGSGGSGGLSGRSDNHGGGSEVQLVESGGGLVQPGGSLKLSCAASGFTFN

KYAMNWVRQAPGKGLEWVARIRSKYNNYATYYADSVKDRFTISRDDSKNTAYLQMNNLKTEDTAVYYCVRHGNFGNS

YISYWAYWGQGTLVTVSSGGGGSGGGGSGGGGSQTVVTQEPSLTVSPGGTVTLTCGSSTGAVTSGYYPNWVQQKPGQ

APRGLIGGTKFLAPGTPARFSGSLLGGKAALTLSGVQPEDEAEYYCALWYSNRWVFGGGTKLTVLGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP021: LC C225
Nucleotide Sequence
                                                             (SEQ ID NO: 457)
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG

Amino Acid Sequence
                                                             (SEQ ID NO: 458)
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI022: C225v5N297Q-15865-CD3HvLv-H-N
pLW048: HC C225v5N297Q-15865-CD3HvLv-H-N
Nucleotide Sequence
[spacer (SEQ ID NO: 507)][pLW048 without spacer (SEQ ID NO: 525)]
                                                             (SEQ ID NO: 463)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTGAGGTGCAGCTGGTCGAGT

CTGGAGGAGGATTGGTGCAGCCTGGAGGGTCATTGAAACTCTCATGTGCAGCCTCTGGATTCACCTTCAATAAGTAC

GCCATGAACTGGGTCCGCCAGGCTCCAGGAAAGGGTTTGGAATGGGTTGCTCGCATAAGAAGTAAATATAATAATTA

TGCAACATATTATGCCGATTCAGTGAAAGACAGGTTCACCATCTCCAGAGATGATTCAAAAAACACTGCCTATCTAC

AAATGAACAACTTGAAAACTGAGGACACTGCCGTGTACTACTGTGTGAGACATGGGAACTTCGGTAATAGCTACATA

TCCTACTGGGCTTACTGGGGCCAAGGGACTCTGGTCACCGTCTCCTCAGGTGGTGGTGGTTCTGGCGGCGGCGGCTC

CGGTGGTGGTGGTTCTCAGACTGTTGTGACTCAGGAACCTTCACTCACCGTATCACCTGGTGGAACAGTCACACTCA

CTTGTGGCTCCTCGACTGGGGCTGTTACATCTGGCTACTACCCAAACTGGGTCCAACAAAAACCAGGTCAGGCACCC

CGTGGTCTAATAGGTGGGACTAAGTTCCTCGCCCCCGGTACTCCTGCCAGATTCTCAGGCTCCCTGCTTGGAGGCAA

GGCTGCCCTCACCCTCTCAGGGGTACAGCCAGAGGATGAGGCAGAATATTACTGTGCTCTATGGTACAGCAACCGCT

GGGTGTTCGGTGGAGGAACCAAACTGACTGTCCTAGGAGGTGGTGGATCCCAGGTGCAGCTGAAACAGAGCGGCCCG
```

-continued

```
GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

Amino Acid Sequence
[spacer (SEQ ID NO: 87)][pLW048 without spacer (SEQ ID NO: 526)]
                                                                (SEQ ID NO: 464)
[QGQSGQ][MMYCGGNEVLCGPRVGSSGGSGGSGGLSGRSDNHGGGSEVQLVESGGGLVQPGGSLKLSCAASGFTFN

KYAMNWVRQAPGKGLEWVARIRSKYNNYATYYADSVKDRFTISRDDSKNTAYLQMNNLKTEDTAVYYCVRHGNFGNS

YISYWAYWGQGTLVTVSSGGGGSGGGGSGGGGSQTVVTQEPSLTVSPGGTVTLTCGSSTGAVTSGYYPNWVQQKPGQ

APRGLIGGTKFLAPGTPARFSGSLLGGKAALTLSGVQPEDEAEYYCALWYSNRWVFGGGTKLTVLGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP021: LC C225
Nucleotide Sequence
                                                                (SEQ ID NO: 457)
GATATCTTGCTGACCCAGAGCCCGGTGATTCTGAGCGTGAGCCCGGGCGAACGTGTGAGCTTTAGCTGCCGCGCGAG

CCAGAGCATTGGCACCAACATTCATTGGTATCAGCAGCGCACCAACGGCAGCCCGCGCCTGCTGATTAAATATGCGA

GCGAAAGCATTAGCGGCATTCCGAGCCGCTTTAGCGGCAGCGGCAGCGGCACCGATTTTACCCTGAGCATTAACAGC

GTGGAAAGCGAAGATATTGCGGATTATTATTGCCAGCAGAACAACAACTGGCCGACCACCTTTGGCGCGGGCACCAA

ACTGGAAATCAAACGTACGGTGGCTGCACCATCTGTCTTCATCTTCCCGCCATCTGATGAGCAGTTGAAATCTGGAA

CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG
```

Amino Acid Sequence (SEQ ID NO: 458)

DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI023: 3954-1204-C225v5N297Q-15003-CD3HvLv-H-N
pLW047: HC C225v5N297Q-15003-CD3HvLv-H-N
Nucleotide Sequence
[spacer (SEQ ID NO: 507)][pLW047 without spacer (SEQ ID NO: 522)]

(SEQ ID NO: 461)

[CAAGGCCAGTCTGGCCAA][GGTTATCGGTGGGGTTGCGAGTGGAATTGCGGTGGGATTACTACTGGCTCGAGCGG

TGGCAGCGGTGGCTCTGGTGGTCTGAGCGGCCGTTCCGATAATCATGGCGGCGGTTCTGAGGTGCAGCTGGTCGAGT

CTGGAGGAGGATTGGTGCAGCCTGGAGGGTCATTGAAACTCTCATGTGCAGCCTCTGGATTCACCTTCAATAAGTAC

GCCATGAACTGGGTCCGCCAGGCTCCAGGAAAGGGTTTGGAATGGGTTGCTCGCATAAGAAGTAAATATAATAATTA

TGCAACATATTATGCCGATTCAGTGAAAGACAGGTTCACCATCTCCAGAGATGATTCAAAAAACACTGCCTATCTAC

AAATGAACAACTTGAAAACTGAGGACACTGCCGTGTACTACTGTGTGAGACATGGGAACTTCGGTAATAGCTACATA

TCCTACTGGGCTTACTGGGGCCAAGGGACTCTGGTCACCGTCTCCTCAGGTGGTGGTGGTTCTGGCGGCGGCGGCTC

CGGTGGTGGTGGTTCTCAGACTGTTGTGACTCAGGAACCTTCACTCACCGTATCACCTGGTGGAACAGTCACACTCA

CTTGTGGCTCCTCGACTGGGGCTGTTACATCTGGCTACTACCCAAACTGGGTCCAACAAAAACCAGGTCAGGCACCC

CGTGGTCTAATAGGTGGGACTAAGTTCCTCGCCCCCGGTACTCCTGCCAGATTCTCAGGCTCCCTGCTTGGAGGCAA

GGCTGCCCTCACCCTCTCAGGGGTACAGCCAGAGGATGAGGCAGAATATTACTGTGCTCTATGGTACAGCAACCGCT

GGGTGTTCGGTGGAGGAACCAAACTGACTGTCCTAGGAGGTGGTGGATCCCAGGTGCAGCTGAAACAGAGCGGCCCG

GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCGCTGACCTATTATGATTATGAATTTGCGTATTGGGGCCAGGG

CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]

Amino Acid Sequence
[spacer (SEQ ID NO: 87)][pLW047 without spacer (SEQ ID NO: 524)]

(SEQ ID NO: 462)

[QGQSGQ][GYRWGCEWNCGGITTGSSGGSGGSGGLSGRSDNHGGGSEVQLVESGGGLVQPGGSLKLSCAASGFTFN

KYAMNWVRQAPGKGLEWVARIRSKYNNYATYYADSVKDRFTISRDDSKNTAYLQMNNLKTEDTAVYYCVRHGNFGNS

YISYWAYWGQGTLVTVSSGGGGSGGGGSGGGGSQTVVTQEPSLTVSPGGTVTLTCGSSTGAVTSGYYPNWVQQKPGQ

-continued

APRGLIGGTKFLAPGTPARFSGSLLGGKAALTLSGVQPEDEAEYYCALWYSNRWVFGGGTKLTVLGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI024: 3954-1204-C225v5N297Q-15865-CD3HvLv-H-N
pLW048: HC C225v5N297Q-15865-CD3HvLv-H-N
Nucleotide Sequence
[spacer (SEQ ID NO: 507)][pLW048 without spacer (SEQ ID NO: 525)]
(SEQ ID NO: 463)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTGAGGTGCAGCTGGTCGAGT

CTGGAGGAGGATTGGTGCAGCCTGGAGGGTCATTGAAACTCTCATGTGCAGCCTCTGGATTCACCTTCAATAAGTAC

GCCATGAACTGGGTCCGCCAGGCTCCAGGAAAGGGTTTGGAATGGGTTGCTCGCATAAGAAGTAAATATAATAATTA

TGCAACATATTATGCCGATTCAGTGAAAGACAGGTTCACCATCTCCAGAGATGATTCAAAAAACACTGCCTATCTAC

AAATGAACAACTTGAAAACTGAGGACACTGCCGTGTACTACTGTGTGAGACATGGGAACTTCGGTAATAGCTACATA

TCCTACTGGGCTTACTGGGGCCAAGGGACTCTGGTCACCGTCTCCTCAGGTGGTGGTGGTTCTGGCGGCGGCGGCTC

CGGTGGTGGTGGTTCTCAGACTGTTGTGACTCAGGAACCTTCACTCACCGTATCACCTGGTGGAACAGTCACACTCA

CTTGTGGCTCCTCGACTGGGGCTGTTACATCTGGCTACTACCCAAACTGGGTCCAACAAAAACCAGGTCAGGCACCC

CGTGGTCTAATAGGTGGGACTAAGTTCCTCGCCCCCGGTACTCCTGCCAGATTCTCAGGCTCCCTGCTTGGAGGCAA

GGCTGCCCTCACCCTCTCAGGGGTACAGCCAGAGGATGAGGCAGAATATTACTGTGCTCTATGGTACAGCAACCGCT

GGGTGTTCGGTGGAGGAACCAAACTGACTGTCCTAGGAGGTGGTGGATCCCAGGTGCAGCTGAAACAGAGCGGCCCG

-continued

```
GGCCTGGTGCAGCCGAGCCAGAGCCTGAGCATTACCTGCACCGTGAGCGGCTTTAGCCTGACCAACTATGGCGTGCA

TTGGGTGCGCCAGAGCCCGGGCAAAGGCCTGGAATGGCTGGGCGTGATTTGGAGCGGCGGCAACACCGATTATAACA

CCCCGTTTACCAGCCGCCTGAGCATTAACAAAGATAACAGCAAAAGCCAGGTGTTTTTTAAAATGAACAGCCTGCAA

AGCCAGGATACCGCGATTTATTATTGCGCGCGCGCTGACCTATTATGATTATGAATTTGCGTATTGGGGCCAGGG

CACCCTGGTGACCGTGAGCGCGGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]
```

Amino Acid Sequence
[spacer (SEQ ID NO: 87)][pLW048 without spacer (SEQ ID NO: 526)]
(SEQ ID NO: 464)
[QGQSGQ][MMYCGGNEVLCGPRVGSSGGSGGSGGLSGRSDNHGGGSEVQLVESGGGLVQPGGSLKLSCAASGFTFN

KYAMNWVRQAPGKGLEWVARIRSKYNNYATYYADSVKDRFTISRDDSKNTAYLQMNNLKTEDTAVYYCVRHGNFGNS

YISYWAYWGQGTLVTVSSGGGGSGGGGSGGGGSQTVVTQEPSLTVSPGGTVTLTCGSSTGAVTSGYYPNWVQQKPGQ

APRGLIGGTKFLAPGTPARFSGSLLGGKAALTLSGVQPEDEAEYYCALWYSNRWVFGGGTKLTVLGGGGSQVQLKQS

GPGLVQPSQSLSITCTVSGFSLTNYGVHWVRQSPGKGLEWLGVIWSGGNTDYNTPFTSRLSINKDNSKSQVFFKMNS

LQSQDTAIYYCARALTYYDYEFAYWGQGTLVTVSAASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)

```
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA
```

```
GCAGACTACGAGAAACACAAAGTCTACGCCTGCGAAGTCACCCATCAGGGCCTGAGCTCGCCCGTCACAAAGAGCTT

CAACAGGGGAGAGTGTTAG]
```

Amino Acid Sequence
[spacer (SEQ ID NO: 87)][OPP022 without spacer (SEQ ID NO: 508)]

(SEQ ID NO: 450)
```
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*
```

CI028: IL6R 4792 Nsub N297Q-15865 1204-CD3LvHv-H-N
pLW085: HC IL6RN297Q-15865 1204-CD3LvHv-H-N
Nucleotide Sequence
[spacer (SEQ ID NO: 507)][pLW085 without spacer (SEQ ID NO: 513)]

(SEQ ID NO: 471)
```
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTCTGAGCGGCCGTTCCGATAATCATGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGCAGGAGTCCGGACCA

GGACTGGTCCGGCCCTCACAGACTCTGAGCCTGACATGCACTGTGTCAGGCTACAGCATCACCTCCGATCACGCCTG

GAGCTGGGTCAGGCAGCCACCTGGACGCGGCCTGGAATGGATCGGCTACATTTCTTATAGTGGGATCACCACATACA

ACCCCTCTCTGAAGAGTCGAGTGACCATTTCCAGAGACAACTCTAAAAATACACTGTATCTGCAGATGAATAGTCTG

CGGGCCGAGGATACAGCTGTGTACTATTGTGCACGGTCTCTGGCCAGAACTACCGCTATGGACTATTGGGGCAGGG

AAGCCTGGTGACCGTCAGCTCCGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]
```

Amino Acid Sequence
[spacer (SEQ ID NO: 87)][pLW085 without spacer (SEQ ID NO: 514)]
(SEQ ID NO: 472)
[QGQSGQ][MMYCGGNEVLCGPRVGSSGGSGGSGGLSGRSDNHGGGSQTVVTQEPSLTVSPGGTVTLTCRSSTGAVT

TSNYANWVQQKPGQAPRGLIGGTNKRAPGTPARFSGSLLGGKAALTLSGVQPEDEAEYYCALWYSNLWVFGGGTKLT

VLGGGGSGGGGSGGGGSEVQLVESGGGLVQPGGSLKLSCAASGFTFNTYAMNWVRQAPGKGLEWVARIRSKYNNYAT

YYADSVKDRFTISRDDSKNTAYLQMNNLKTEDTAVYYCVRHGNFGNSYVSWFAYWGQGTLVTVSSGGGGSGQVQLQES

GPGLVRPSQTLSLTCTVSGYSITSDHAWSWVRQPPGRGLEWIGYISYSGITTYNPSLKSRVTISRDNSKNTLYLQMN

SLRAEDTAVYYCARSLARTTAMDYWGQGSLVTVSSASTKGPSVFPLAPSSKSTSGGTAALGCLVKDYFPEPVTVSWN

SGALTSGVHTFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYQSTYRVVSVLTVLHQDW

LNGKEYKCKVSNKALPAPIEKTISKAKGQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKSLSLSPGK]* pLW079: LC IL6R 4792 Nsub
Nucleotide Sequence
[spacer (SEQ ID NO: 507)][pLW079 without spacer (SEQ ID NO: 527)]
(SEQ ID NO: 473)
[CAAGGCCAGTCTGGCCAG][TATGGGTCCTGCAGTTGGAACTATGTACACATATTCATGGATTGCGGCTCGAGCGG

TGGCAGCGGTGGCTCTGGTGGCTCAGGTGGAGGCTCGGGCGGTGGGAGCGGCGGTTCTGACATCCAGATGACTCAGT

CTCCTAGCTCCCTGTCCGCCTCTGTGGGGGACCGAGTCACCATCACATGCAGAGCCAGCCAGGATATTTCTAGTTAC

CTGAACTGGTATCAGCAGAAGCCCGGAAAAGCACCTAAGCTGCTGATCTACTATACCTCCAGGCTGCACTCTGGCGT

GCCCAGTCGGTTCAGTGGCTCAGGGAGCGGAACCGACTTCACTTTTACCATCTCAAGCCTGCAGCCAGAGGATATTG

CCACATACTATTGTCAGCAGGGCAATACACTGCCCTACACTTTTGGCCAGGGGACCAAGGTGGAAATCAAACGTACG

GTGGCTGCACCATCTGTCTTCATCTTCCCGCCATCTGATGAGCAGTTGAAATCTGGAACTGCCTCTGTTGTGTGCCT

GCTGAATAACTTCTATCCCAGAGAGGCCAAAGTACAGTGGAAGGTGGATAACGCCCTCCAATCGGGTAACTCCCAGG

AGAGTGTCACAGAGCAGGACAGCAAGGACAGCACCTACAGCCTCAGCAGCACCCTGACGCTGAGCAAAGCAGACTAC

GAGAAACACAAAGTCTACGCCTGCGAAGTCACCCATCAGGGCCTGAGCTCGCCCGTCACAAAGAGCTTCAACAGGGG

AGAGTGTTAG]

Amino Acid Sequence
[spacer (SEQ ID NO: 87)][pLW079 without spacer (SEQ ID NO: 528)]
(SEQ ID NO: 474)
[QGQSGQ][YGSCSWNYVHIFMDCGSSGGSGGSGGSGGGSGGGSGGSDIQMTQSPSSLSASVGDRVTITCRASQDIS

SYLNWYQQKPGKAPKLLIYYTSRLHSGVPSRFSGSGSGTDFTFTISSLQPEDIATYYCQQGNTLPYTFGQGTKVEIK

RTVAAPSVFIFPPSDEQLKSGTASVVCLLNNFYPREAKVQWKVDNALQSGNSQESVTEQDSKDSTYSLSSTLTLSKA

DYEKHKVYACEVTHQGLSSPVTKSFNRGEC]*

CI030: IL6RN297Q-15865 Nsub-CD3LvHv-H-N
pLW087: HC IL6RN297Q-15865_Nsub-CD3LvHv-H-N
Nucleotide Sequence
[spacer (SEQ ID NO: 507)][pLW087 without spacer (SEQ ID NO: 529)]
(SEQ ID NO: 477)
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTGGTGGAGGCTCGGGCGGTGGGAGCGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

-continued

```
TGCGGCAGGCACCTGGGAAGGGACTGGAATGGGTCGCCCGGATCAGATCTAAATACAATAACTATGCCACCTACTAT
GCTGACAGTGTGAAGGATAGGTTCACCATTTCACGCGACGATAGCAAAAACACAGCTTATCTGCAGATGAATAACCT
GAAGACCGAGGATACAGCAGTGTACTATTGCGTCAGACACGGCAATTTCGGGAACTCTTACGTGAGTTGGTTTGCCT
ATTGGGGACAGGGGACACTGGTCACCGTCTCCTCAGGAGGTGGTGGATCCCAGGTGCAGCTGCAGGAGTCCGGACCA
GGACTGGTCCGGCCCTCACAGACTCTGAGCCTGACATGCACTGTGTCAGGCTACAGCATCACCTCCGATCACGCCTG
GAGCTGGGTCAGGCAGCCACCTGGACGCGGCCTGGAATGGATCGGCTACATTTCTTATAGTGGGATCACCACATACA
ACCCCTCTCTGAAGAGTCGAGTGACCATTTCCAGAGACAACTCTAAAAATACACTGTATCTGCAGATGAATAGTCTG
CGGGCCGAGGATACAGCTGTGTACTATTGTGCACGGTCTCTGGCCAGAACTACCGCTATGGACTATTGGGGCAGGG
AAGCCTGGTGACCGTCAGCTCCGCTAGCACCAAGGGCCCATCGGTCTTCCCCCTGGCACCCTCCTCCAAGAGCACCT
CTGGGGGCACAGCGGCCCTGGGCTGCCTGGTCAAGGACTACTTCCCCGAACCGGTGACGGTGTCGTGGAACTCAGGC
GCCCTGACCAGCGGCGTGCACACCTTCCCGGCTGTCCTACAGTCCTCAGGACTCTACTCCCTCAGCAGCGTGGTGAC
CGTGCCCTCCAGCAGCTTGGGCACCCAGACCTACATCTGCAACGTGAATCACAAGCCCAGCAACACCAAGGTGGACA
AGAAAGTTGAGCCCAAATCTTGTGACAAAACTCACACATGCCCACCGTGCCCAGCACCTGAACTCCTGGGGGGACCG
TCAGTCTTCCTCTTCCCCCCAAAACCCAAGGACACCCTCATGATCTCCCGGACCCCTGAGGTCACATGCGTGGTGGT
GGACGTGAGCCACGAAGACCCTGAGGTCAAGTTCAACTGGTACGTGGACGGCGTGGAGGTGCATAATGCCAAGACAA
AGCCGCGGGAGGAGCAGTACCAGAGCACGTACCGTGTGGTCAGCGTCCTCACCGTCCTGCACCAGGACTGGCTGAAT
GGCAAGGAGTACAAGTGCAAGGTCTCCAACAAAGCCCTCCCAGCCCCCATCGAGAAAACCATCTCCAAAGCCAAAGG
GCAGCCCCGAGAACCACAGGTGTACACCCTGCCCCCATCCCGGGAGGAGATGACCAAGAACCAGGTCAGCCTGACCT
GCCTGGTCAAAGGCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTACACGCAGAAGAGCCTCTCCCTGT
CTCCGGGTAAATGA]
```

Amino Acid Sequence
[spacer (SEQ ID NO: 87)][pLW087 without spacer (SEQ ID NO: 530)]
(SEQ ID NO: 478)
[QGQSGQ][MMYCGGNEVLCGPRVGSSGGSGGSGGGGSGGGSGGGSQTVVTQEPSLTVSPGGTVTLTCRSSTGAVT
TSNYANWVQQKPGQAPRGLIGGTNKRAPGTPARFSGSLLGGKAALTLSGVQPEDEAEYYCALWYSNLWVFGGGTKLT
VLGGGGSGGGGSGGGGSEVQLVESGGGLVQPGGSLKLSCAASGFTFNTYAMNWVRQAPGKGLEWVARIRSKYNNYAT
YYADSVKDRFTISRDDSKNTAYLQMNNLKTEDTAVYYCVRHGNFGNSYVSWFAYWGQGTLVTVSSGGGGSQVQLQES
GPGLVRPSQTLSLTCTVSGYSITSDHAWSWVRQPPGRGLEWIGYISYSGITTYNPSLKSRVTISRDNSKNTLYLQMN
SLRAEDTAVYYCARSLARTTAMDYWGQGSLVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK]* pLW077: LC IL6R
Nucleotide Sequence
(SEQ ID NO: 467)
```
GACATCCAGATGACTCAGTCTCCTAGCTCCCTGTCCGCCTCTGTGGGGGACCGAGTCACCATCACATGCAGAGCCAG
CCAGGATATTTCTAGTTACCTGAACTGGTATCAGCAGAAGCCCGAAAAGCACCTAAGCTGCTGATCTACTATACCT
CCAGGCTGCACTCTGGCGTGCCCAGTCGGTTCAGTGGCTCAGGGAGCGGAACCGACTTCACTTTTACCATCTCAAGC
CTGCAGCCAGAGGATATTGCCACATACTATTGTCAGCAGGGCAATACACTGCCCTACACTTTTGGCCAGGGGACCAA
GGTGGAAATCAAACGTACGGTGGCTGCACCATCTGTCTTCATCTTCCCGCCATCTGATGAGCAGTTGAAATCTGGAA
```

-continued

```
CTGCCTCTGTTGTGTGCCTGCTGAATAACTTCTATCCCAGAGAGGCCAAAGTACAGTGGAAGGTGGATAACGCCCTC

CAATCGGGTAACTCCCAGGAGAGTGTCACAGAGCAGGACAGCAAGGACAGCACCTACAGCCTCAGCAGCACCCTGAC

GCTGAGCAAAGCAGACTACGAGAAACACAAAGTCTACGCCTGCGAAGTCACCCATCAGGGCCTGAGCTCGCCCGTCA

CAAAGAGCTTCAACAGGGGAGAGTGTTAG
```

Amino Acid Sequence (SEQ ID NO: 468)
```
DIQMTQSPSSLSASVGDRVTITCRASQDISSYLNWYQQKPGKAPKLLIYYTSRLHSGVPSRFSGSGSGTDFTFTISS

LQPEDIATYYCQQGNTLPYTFGQGTKVEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*
```

CI031: IL6R 4792 Nsub N297Q-15865 Nsub-CD3LvHv-H-N
pLW087: HC IL6RN297Q-15865_Nsub-CD3LvHv-H-N
Nucleotide Sequence
[spacer (SEQ ID NO: 507)][pLW087 without spacer (SEQ ID NO: 529)]

(SEQ ID NO: 477)
```
[CAAGGCCAGTCTGGCCAA][ATGATGTATTGCGGTGGGAATGAGGTGTTGTGCGGGCCGCGGGTTGGCTCGAGCGG

TGGCAGCGGTGGCTCTGGTGGTGGTGGAGGCTCGGGCGGTGGGAGCGGCGGCGGTTCTCAGACCGTGGTCACACAGG

AGCCCTCACTGACAGTGAGCCCTGGCGGGACCGTCACACTGACTTGTCGCAGTTCAACTGGCGCCGTGACTACCAGC

AATTACGCTAACTGGGTCCAGCAGAAACCAGGACAGGCACCACGAGGACTGATCGGAGGAACTAATAAGAGAGCACC

AGGAACCCCTGCAAGGTTCTCCGGATCTCTGCTGGGGGGAAAAGCCGCTCTGACACTGAGCGGCGTGCAGCCTGAGG

ACGAAGCTGAGTACTATTGCGCACTGTGGTACTCCAACCTGTGGGTGTTTGGCGGGGGAACTAAGCTGACCGTCCTG

GGAGGAGGAGGAAGCGGAGGAGGAGGGAGCGGAGGAGGAGGATCCGAAGTGCAGCTGGTCGAGAGCGGAGGAGGACT

GGTGCAGCCAGGAGGATCCCTGAAGCTGTCTTGTGCAGCCAGTGGCTTCACCTTCAACACTTACGCAATGAACTGGG

TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGCAGGAGTCCGGACCA

GGACTGGTCCGGCCCTCACAGACTCTGAGCCTGACATGCACTGTGTCAGGCTACAGCATCACCTCCGATCACGCCTG

GAGCTGGGTCAGGCAGCCACCTGGACGCGGCCTGGAATGGATCGGCTACATTTCTTATAGTGGGATCACCACATACA

ACCCCTCTCTGAAGAGTCGAGTGACCATTTCCAGAGACAACTCTAAAAATACACTGTATCTGCAGATGAATAGTCTG

CGGGCCGAGGATACAGCTGTGTACTATTGTGCACGGTCTCTGGCCAGAACTACCGCTATGGACTATTGGGGCAGGG

AAGCCTGGTGACCGTCAGCTCCGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]
```

-continued

Amino Acid Sequence
[spacer (SEQ ID NO: 87)][pLW087 without spacer (SEQ ID NO: 530)]
(SEQ ID NO: 478)
[QGQSGQ][MMYCGGNEVLCGPRVGSSGGSGGSGGGGGSGGGSGGGSQTVVTQEPSLTVSPGGTVTLTCRSSTGAVT
TSNYANWVQQKPGQAPRGLIGGTNKRAPGTPARFSGSLLGGKAALTLSGVQPEDEAEYYCALWYSNLWVFGGGTKLT
VLGGGGSGGGGSGGGGSEVQLVESGGGLVQPGGSLKLSCAASGFTFNTYAMNWVRQAPGKGLEWVARIRSKYNNYAT
YYADSVKDRFTISRDDSKNTAYLQMNNLKTEDTAVYYCVRHGNFGNSYVSWFAYWGQGTLVTVSSGGGGSQVQLQES
GPGLVRPSQTLSLTCTVSGYSITSDHAWSWVRQPPGRGLEWIGYISYSGITTYNPSLKSRVTISRDNSKNTLYLQMN
SLRAEDTAVYYCARSLARTTAMDYWGQGSLVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK]* pLW079: LC IL6R 4792 Nsub
Nucleotide Sequence
[spacer (SEQ ID NO: 507)][pLW079 without spacer (SEQ ID NO: 527)]
(SEQ ID NO: 473)
[CAAGGCCAGTCTGGCCAG][TATGGGTCCTGCAGTTGGAACTATGTACACATATTCATGGATTGCGGCTCGAGCGG
TGGCAGCGGTGGCTCTGGTGGCTCAGGTGGAGGCTCGGGCGGTGGGAGCGGCGGTTCTGACATCCAGATGACTCAGT
CTCCTAGCTCCCTGTCCGCCTCTGTGGGGGACCGAGTCACCATCACATGCAGAGCCAGCCAGGATATTTCTAGTTAC
CTGAACTGGTATCAGCAGAAGCCCGGAAAAGCACCTAAGCTGCTGATCTACTATACCTCCAGGCTGCACTCTGGCGT
GCCCAGTCGGTTCAGTGGCTCAGGGAGCGGAACCGACTTCACTTTTACCATCTCAAGCCTGCAGCCAGAGGATATTG
CCACATACTATTGTCAGCAGGGCAATACACTGCCCTACACTTTTGGCCAGGGGACCAAGGTGGAAATCAAACGTACG
GTGGCTGCACCATCTGTCTTCATCTTCCCGCCATCTGATGAGCAGTTGAAATCTGGAACTGCCTCTGTTGTGTGCCT
GCTGAATAACTTCTATCCCAGAGAGGCCAAAGTACAGTGGAAGGTGGATAACGCCCTCCAATCGGGTAACTCCCAGG
AGAGTGTCACAGAGCAGGACAGCAAGGACAGCACCTACAGCCTCAGCAGCACCCTGACGCTGAGCAAAGCAGACTAC
GAGAAACACAAAGTCTACGCCTGCGAAGTCACCCATCAGGGCCTGAGCTCGCCCGTCACAAAGAGCTTCAACAGGGG
AGAGTGTTAG]

Amino Acid Sequence
[spacer (SEQ ID NO: 87)][pLW079 without spacer (SEQ ID NO: 528)]
(SEQ ID NO: 474)
[QGQSGQ][YGSCSWNYVHIFMDCGSSGGSGGSGGSGGGSGGGSGGSDIQMTQSPSSLSASVGDRVTITCRASQDIS
SYLNWYQQKPGKAPKLLIYYTSRLHSGVPSRFSGSGSGTDFTFTISSLQPEDIATYYCQQGNTLPYTFGQGTKVEIK
RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC]*

CI032: 4792-1204-IL6RN297Q-15865 Nsub-CD3LvHv-H-N
pLW087: HC IL6RN297Q-15865_Nsub-CD3LvHv-H-N
Nucleotide Sequence
[spacer (SEQ ID NO: 507)][pLW087 without spacer (SEQ ID NO: 529)]
(SEQ ID NO: 477)
[CAAGGCCAGTCTGGCCAA][ATGATGTATTGCGGTGGGAATGAGGTGTTGTGCGGGCCGCGGGTTGGCTCGAGCGG
TGGCAGCGGTGGCTCTGGTGGTGGTGGAGGCTCGGGCGGTGGGAGCGGCGGCGGTTCTCAGACCGTGGTCACACAGG
AGCCCTCACTGACAGTGAGCCCTGGCGGGACCGTCACACTGACTTGTCGCAGTTCAACTGGCGCCGTGACTACCAGC
AATTACGCTAACTGGGTCCAGCAGAAACCAGGACAGGCACCACGAGGACTGATCGGAGGAACTAATAAGAGAGCACC
AGGAACCCCTGCAAGGTTCTCCGGATCTCTGCTGGGGGGAAAAGCCGCTCTGACACTGAGCGGCGTGCAGCCTGAGG
ACGAAGCTGAGTACTATTGCGCACTGTGGTACTCCAACCTGTGGGTGTTTGGCGGGGAACTAAGCTGACCGTCCTG
GGAGGAGGAGGAAGCGGAGGAGGAGGGAGCGGAGGAGGAGGATCCGAAGTGCAGCTGGTCGAGAGCGGAGGAGGACT
GGTGCAGCCAGGAGGATCCCTGAAGCTGTCTTGTGCAGCCAGTGGCTTCACCTTCAACACTTACGCAATGAACTGGG -continued

```
TGCGGCAGGCACCTGGGAAGGGACTGGAATGGGTCGCCCGGATCAGATCTAAATACAATAACTATGCCACCTACTAT

GCTGACAGTGTGAAGGATAGGTTCACCATTTCACGCGACGATAGCAAAAACACAGCTTATCTGCAGATGAATAACCT

GAAGACCGAGGATACAGCAGTGTACTATTGCGTCAGACACGGCAATTTCGGGAACTCTTACGTGAGTTGGTTTGCCT

ATTGGGGACAGGGGACACTGGTCACCGTCTCCTCAGGAGGTGGTGGATCCCAGGTGCAGCTGCAGGAGTCCGGACCA

GGACTGGTCCGGCCCTCACAGACTCTGAGCCTGACATGCACTGTGTCAGGCTACAGCATCACCTCCGATCACGCCTG

GAGCTGGGTCAGGCAGCCACCTGGACGCGGCCTGGAATGGATCGGCTACATTTCTTATAGTGGGATCACCACATACA

ACCCCTCTCTGAAGAGTCGAGTGACCATTTCCAGAGACAACTCTAAAAATACACTGTATCTGCAGATGAATAGTCTG

CGGGCCGAGGATACAGCTGTGTACTATTGTGCACGGTCTCTGGCCAGAACTACCGCTATGGACTATTGGGGCAGGG

AAGCCTGGTGACCGTCAGCTCCGCTAGCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGTGTCGTGGAACTCAGGC

GCCCTGACCAGCGGCGTGCACACCTTCCCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATCACAAGCCCAGCAACACCAAGGTGGACA

AGAAAGTTGAGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGCGTGGTGGT

GGACGTGAGCCACGAAGACCCTGAGGTCAAGTTCAACTGGTACGTGGACGGCGTGGAGGTGCATAATGCCAAGACAA

AGCCGCGGGAGGAGCAGTACCAGAGCACGTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCATCGAGAAAACCATCTCCAAAGCCAAAGG

GCAGCCCCGAGAACCACAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCCGGAGAACAACTACAAG

ACCACGCCTCCCGTGCTGGACTCCGACGGCTCCTTCTTCCTCTACAGCAAGCTCACCGTGGACAAGAGCAGGTGGCA

GCAGGGGAACGTCTTCTCATGCTCCGTGATGCATGAGGCTCTGCACAACCACTACACGCAGAAGAGCCTCTCCCTGT

CTCCGGGTAAATGA]
```

Amino Acid Sequence
[spacer (SEQ ID NO: 87)][pLW087 without spacer (SEQ ID NO: 530)]

(SEQ ID NO: 478)

[QGQSGQ][MMYCGGNEVLCGPRVGSSGGSGGSGGGGGSGGGSGGGSQTVVTQEPSLTVSPGGTVTLTCRSSTGAVT
TSNYANWVQQKPGQAPRGLIGGTNKRAPGTPARFSGSLLGGKAALTLSGVQPEDEAEYYCALWYSNLWVFGGGTKLT
VLGGGGSGGGGSGGGGSEVQLVESGGGLVQPGGSLKLSCAASGFTFNTYAMNWVRQAPGKGLEWVARIRSKYNNYAT
YYADSVKDRFTISRDDSKNTAYLQMNNLKTEDTAVYYCVRHGNFGNSYVSWFAYWGQGTLVTVSSGGGGSGVQLQES
GPGLVRPSQTLSLTCTVSGYSITSDHAWSWVRQPPGRGLEWIGYISYSGITTYNPSLKSRVTISRDNSKNTLYLQMN
SLRAEDTAVYYCARSLARTTAMDYWGQGSLVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK]* pLW080: LC IL6R 4792 1204
Nucleotide Sequence
[spacer (SEQ ID NO: 507)][pLW080 without spacer (SEQ ID NO: 515)]

(SEQ ID NO: 473)

[CAAGGCCAGTCTGGCCAG][TATGGGTCCTGCAGTTGGAACTATGTACACATATTCATGGATTGCGGCTCGAGCGG

TGGCAGCGGTGGCTCTGGTGGTCTGAGCGGCCGTTCCGATAATCATGGCGGCGGTTCTGACATCCAGATGACTCAGT

CTCCTAGCTCCCTGTCCGCCTCTGTGGGGACCGAGTCACCATCACATGCAGAGCCAGCCAGGATATTTCTAGTTAC

CTGAACTGGTATCAGCAGAAGCCCGGAAAAGCACCTAAGCTGCTGATCTACTATACCTCCAGGCTGCACTCTGGCGT

GCCCAGTCGGTTCAGTGGCTCAGGGAGCGGAACCGACTTCACTTTTACCATCTCAAGCCTGCAGCCAGAGGATATTG
```

-continued

```
CCACATACTATTGTCAGCAGGGCAATACACTGCCCTACACTTTTGGCCAGGGGACCAAGGTGGAAATCAAACGTACG

GTGGCTGCACCATCTGTCTTCATCTTCCCGCCATCTGATGAGCAGTTGAAATCTGGAACTGCCTCTGTTGTGTGCCT

GCTGAATAACTTCTATCCCAGAGAGGCCAAAGTACAGTGGAAGGTGGATAACGCCCTCCAATCGGGTAACTCCCAGG

AGAGTGTCACAGAGCAGGACAGCAAGGACAGCACCTACAGCCTCAGCAGCACCCTGACGCTGAGCAAAGCAGACTAC

GAGAAACACAAAGTCTACGCCTGCGAAGTCACCCATCAGGGCCTGAGCTCGCCCGTCACAAAGAGCTTCAACAGGGG

AGAGTGTTAG]
```

Amino Acid Sequence
[spacer (SEQ ID NO: 87)][pLW080 without spacer (SEQ ID NO: 516)]

(SEQ ID NO: 474)

[QGQSGQ][YGSCSWNYVHIFMDCGSSGGSGGSGGLSGRSDNHGGGSDIQMTQSPSSLSASVGDRVTITCRASQDIS

SYLNWYQQKPGKAPKLLIYYTSRLHSGVPSRFSGSGSGTDFTFTISSLQPEDIATYYCQQGNTLPYTFGQGTKVEIK

RTVAAPSVFIFPPSDEQLKSGTASVVCLLNNFYPREAKVQWKVDNALQSGNSQESVTEQDSKDSTYSLSSTLTLSKA

DYEKHKVYACEVTHQGLSSPVTKSFNRGEC]*

CI048: Activated CI011
HC C225v5N297Q-*CD3LvHv-H-N
Nucleotide Sequence (SEQ ID NO: 451)

```
CAAGGCCAGTCTGGCCAAATGATGTATTGCGGTGGGAATGAGGTGTTGTGCGGGCCGCGGGTTGGCTCGAGCGGTGG

CAGCGGTGGCTCTGGTGGTCTGAGCGGCCGTTCCGATAATCATGGCGGCGGTTCTCAGACCGTGGTCACACAGGAGC

CCTCACTGACAGTGAGCCCTGGCGGGACCGTCACACTGACTTGTCGCAGTTCAACTGGCGCCGTGACTACCAGCAAT

TACGCTAACTGGGTCCAGCAGAAACCAGGACAGGCACCACGAGGACTGATCGGAGGAACTAATAAGAGAGCACCAGG

AACCCCTGCAAGGTTCTCCGGATCTCTGCTGGGGGGAAAAGCCGCTCTGACACTGAGCGGCGTGCAGCCTGAGGACG

AAGCTGAGTACTATTGCGCACTGTGGTACTCCAACCTGTGGGTGTTTGGCGGGGGAACTAAGCTGACCGTCCTGGGA

GGAGGAGGAAGCGGAGGAGGAGGGAGCGGAGGAGGAGGATCCGAAGTGCAGCTGGTCGAGAGCGGAGGAGGACTGGT

GCAGCCAGGAGGATCCCTGAAGCTGTCTTGTGCAGCCAGTGGCTTCACCTTCAACACTTACGCAATGAACTGGGTGC

GGCAGGCACCTGGGAAGGGACTGGAATGGGTCGCCCGGATCAGATCTAAATACAATAACTATGCCACCTACTATGCT

GACAGTGTGAAGGATAGGTTCACCATTTCACGCGACGATAGCAAAAACACAGCTTATCTGCAGATGAATAACCTGAA

GACCGAGGATACAGCAGTGTACTATTGCGTCAGACACGGCAATTTCGGGAACTCTTACGTGAGTTGGTTTGCCTATT

GGGGACAGGGGACACTGGTCACCGTCTCCTCAGGAGGTGGTGGATCCCAGGTGCAGCTGAAACAGAGCGGCCCGGGC

CTGGTGCAGCCGAGCCAGAGCCTGAGCATTACCTGCACCGTGAGCGGCTTTAGCCTGACCAACTATGGCGTGCATTG

GGTGCGCCAGAGCCCGGGCAAAGGCCTGGAATGGCTGGGCGTGATTTGGAGCGGCGGCAACACCGATTATAACACCC

CGTTTACCAGCCGCCTGAGCATTAACAAAGATAACAGCAAAAGCCAGGTGTTTTTTAAAATGAACAGCCTGCAAAGC

CAGGATACCGCGATTTATTATTGCGCGCGCGCGCTGACCTATTATGATTATGAATTTGCGTATTGGGGCCAGGGCAC

CCTGGTGACCGTGAGCGCGGCTAGCACCAAGGGCCCATCGGTCTTCCCCCTGGCACCCTCCTCCAAGAGCACCTCTG

GGGGCACAGCGGCCCTGGGCTGCCTGGTCAAGGACTACTTCCCCGAACCGGTGACGGTGTCGTGGAACTCAGGCGCC

CTGACCAGCGGCGTGCACACCTTCCCGGCTGTCCTACAGTCCTCAGGACTCTACTCCCTCAGCAGCGTGGTGACCGT

GCCCTCCAGCAGCTTGGGCACCCAGACCTACATCTGCAACGTGAATCACAAGCCCAGCAACACCAAGGTGGACAAGA

AAGTTGAGCCCAAATCTTGTGACAAAACTCACACATGCCCACCGTGCCCAGCACCTGAACTCCTGGGGGGACCGTCA

GTCTTCCTCTTCCCCCCAAAACCCAAGGACACCCTCATGATCTCCCGGACCCCTGAGGTCACATGCGTGGTGGTGGA

CGTGAGCCACGAAGACCCTGAGGTCAAGTTCAACTGGTACGTGGACGGCGTGGAGGTGCATAATGCCAAGACAAAGC

CGCGGGAGGAGCAGTACCAGAGCACGTACCGTGTGGTCAGCGTCCTCACCGTCCTGCACCAGGACTGGCTGAATGGC

AAGGAGTACAAGTGCAAGGTCTCCAACAAAGCCCTCCCAGCCCCCATCGAGAAAACCATCTCCAAAGCCAAAGGGCA

GCCCCGAGAACCACAGGTGTACACCCTGCCCCCATCCCGGGAGGAGATGACCAAGAACCAGGTCAGCCTGACCTGCC

TGGTCAAAGGCTTCTATCCCAGCGACATCGCCGTGGAGTGGGAGAGCAATGGGCAGCCGGAGAACAACTACAAGACC
```

-continued

```
ACGCCTCCCGTGCTGGACTCCGACGGCTCCTTCTTCCTCTACAGCAAGCTCACCGTGGACAAGAGCAGGTGGCAGCA
GGGGAACGTCTTCTCATGCTCCGTGATGCATGAGGCTCTGCACAACCACTACACGCAGAAGAGCCTCTCCCTGTCTC
CGGGTAAATGA
```

Amino Acid Sequence (SEQ ID NO: 452)

```
SDNHGGGSQTVVTQEPSLTVSPGGTVTLTCRSSTGAVTTSNYANWVQQKPGQAPRGLIGGTNKRAPGTPARFSGSLL
GGKAALTLSGVQPEDEAEYYCALWYSNLWVFGGGTKLTVLGGGGSGGGGSGGGGSEVQLVESGGGLVQPGGSLKLSC
AASGFTFNTYAMNWVRQAPGKGLEWVARIRSKYNNYATYYADSVKDRFTISRDDSKNTAYLQMNNLKTEDTAVYYCV
RHGNFGNSYVSWFAYWGQGTLVTVSSGGGGSQVQLKQSGPGLVQPSQSLSITCTVSGFSLTNYGVHWVRQSPGKGLE
WLGVIWSGGNTDYNTPFTSRLSINKDNSKSQVFFKMNSLQSQDTAIYYCARALTYYDYEFAYWGQGTLVTVSAASTK
GPSVFPLAPSSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDVSHEDPEVKF
NWYVDGVEVHNAKTKPREEQYQSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQGNVFSCSVMH
EALHNHYTQKSLSLSPGK
```

Activated Light Chain
Nucleotide Sequence (SEQ ID NO: 483)

```
TCCGATAATCATGGCAGTAGCGGTACCCAGATCTTGCTGACCCAGAGCCCGGTGATTCTGAGCGTGAGCCCGGGCGA
ACGTGTGAGCTTTAGCTGCCGCGCGAGCCAGAGCATTGGCACCAACATTCATTGGTATCAGCAGCGCACCAACGGCA
GCCCGCGCCTGCTGATTAAATATGCGAGCGAAAGCATTAGCGGCATTCCGAGCCGCTTTAGCGGCAGCGGCAGCGGC
ACCGATTTTACCCTGAGCATTAACAGCGTGGAAAGCGAAGATATTGCGGATTATTATTGCCAGCAGAACAACAACTG
GCCGACCACCTTTGGCGCGGGCACCAAACTGGAACTGAAACGTACGGTGGCTGCACCATCTGTCTTCATCTTCCCGC
CATCTGATGAGCAGTTGAAATCTGGAACTGCCTCTGTTGTGTGCCTGCTGAATAACTTCTATCCCAGAGAGGCCAAA
GTACAGTGGAAGGTGGATAACGCCCTCCAATCGGGTAACTCCCAGGAGAGTGTCACAGAGCAGGACAGCAAGGACAG
CACCTACAGCCTCAGCAGCACCCTGACGCTGAGCAAAGCAGACTACGAGAAACACAAAGTCTACGCCTGCGAAGTCA
CCCATCAGGGCCTGAGCTCGCCCGTCACAAAGAGCTTCAACAGGGGAGAGTGTTAG
```

Amino Acid Sequence (SEQ ID NO: 484)

```
SDNHGSSGTQILLTQSPVILSVSPGERVSFSCRASQSIGTNIHWYQQRTNGSPRLLIKYASESISGIPSRFSGSGSG
TDFTLSINSVESEDIADYYCQQNNNWPTTFGAGTKLELKRTVAAPSVFIFPPSDEQLKSGTASVVCLLNNFYPREAK
VQWKVDNALQSGNSQESVTEQDSKDSTYSLSSTLTLSKADYEKHKVYACEVTHQGLSSPVTKSFNRGEC
```

CI052: C225v5N297Q-mCD3-H-N
pLW100: HC C225v5N297Q-mCD3-H-N
Nucleotide Sequence (SEQ ID NO: 491)

```
GAAGTGCAGCTGGTGGAATCTGGGGGCGGACTGGTGCAGCCTGGCAAGTCTCTGAAGCTGAGCTGCGAGGCCAGCGG
CTTCACCTTTAGCGGCTACGGCATGCACTGGGTGCGCCAGGCACCTGGCAGAGGCCTGGAAAGCGTGGCCTACATCA
CCAGCAGCAGCATCAACATTAAGTACGCCGACGCCGTGAAGGGCCGGTTCACCGTGTCCAGAGACAACGCCAAGAAC
CTGCTGTTCCTGCAGATGAACATCCTGAAGTCCGAGGACACCGCCATGTACTACTGCGCCAGATTCGACTGGGACAA
GAACTACTGGGGCCAGGGCACAATGGTCACAGTGTCCAGCGGTGGAGGTGGTAGTGGTGGAGGAAGTGGAGGTTCAG
GAGGTGGAAGCGGTGGTGGTGGTAGTGACATCCAGATGACCCAGAGCCCCAGCAGCCTGCCTGCCTCTCTGGGCGAT
AGAGTGACCATCAACTGCCAGGCCAGCCAGGACATCAGCAACTACCTGAACTGGTATCAGCAGAAGCCCGGCAAGGC
CCCCAAGCTGCTGATCTACTACACCAACAAGCTGGCCGACGGTGTGCCCAGCAGATTCAGCGGCAGCGGTAGCGGCA
GAGACAGCAGCTTCACCATCAGCTCCCTGGAATCCGAGGATATCGGCAGCTACTACTGCCAGCAGTACTACAACTAC
CCCTGGACCTTCGGCCCTGGCACCAAGCTGGAAATCAAAAGAGGAGGTGGTGGATCCCAGGTGCAGCTGAAACAGAG
```

-continued

```
CGGCCCGGGCCTGGTGCAGCCGAGCCAGAGCCTGAGCATTACCTGCACCGTGAGCGGCTTTAGCCTGACCAACTATG
GCGTGCATTGGGTGCGCCAGAGCCCGGGCAAAGGCCTGGAATGGCTGGGCGTGATTTGGAGCGGCGGCAACACCGAT
TATAACACCCCGTTTACCAGCCGCCTGAGCATTAACAAAGATAACAGCAAAAGCCAGGTGTTTTTTAAAATGAACAG
CCTGCAAAGCCAGGATACCGCGATTTATTATTGCGCGCGCGCGCTGACCTATTATGATTATGAATTTGCGTATTGGG
GCCAGGGCACCCTGGTGACCGTGAGCGCGGCTAGCACCAAGGGCCCATCGGTCTTCCCCCTGGCACCCTCCTCCAAG
AGCACCTCTGGGGGCACAGCGGCCCTGGGCTGCCTGGTCAAGGACTACTTCCCCGAACCGGTGACGGTGTCGTGGAA
CTCAGGCGCCCTGACCAGCGGCGTGCACACCTTCCCGGCTGTCCTACAGTCCTCAGGACTCTACTCCCTCAGCAGCG
TGGTGACCGTGCCCTCCAGCAGCTTGGGCACCCAGACCTACATCTGCAACGTGAATCACAAGCCCAGCAACACCAAG
GTGGACAAGAAAGTTGAGCCCAAATCTTGTGACAAAACTCACACATGCCCACCGTGCCCAGCACCTGAACTCCTGGG
GGGACCGTCAGTCTTCCTCTTCCCCCCAAAACCCAAGGACACCCTCATGATCTCCCGGACCCCTGAGGTCACATGCG
TGGTGGTGGACGTGAGCCACGAAGACCCTGAGGTCAAGTTCAACTGGTACGTGGACGGCGTGGAGGTGCATAATGCC
AAGACAAAGCCGCGGGAGGAGCAGTACCAGAGCACGTACCGTGTGGTCAGCGTCCTCACCGTCCTGCACCAGGACTG
GCTGAATGGCAAGGAGTACAAGTGCAAGGTCTCCAACAAAGCCCTCCCAGCCCCCATCGAGAAAACCATCTCCAAAG
CCAAAGGGCAGCCCCGAGAACCACAGGTGTACACCCTGCCCCCATCCCGGGAGGAGATGACCAAGAACCAGGTCAGC
CTGACCTGCCTGGTCAAAGGCTTCTATCCCAGCGACATCGCCGTGGAGTGGGAGAGCAATGGGCAGCCGGAGAACAA
CTACAAGACCACGCCTCCCGTGCTGGACTCCGACGGCTCCTTCTTCCTCTACAGCAAGCTCACCGTGGACAAGAGCA
GGTGGCAGCAGGGGAACGTCTTCTCATGCTCCGTGATGCATGAGGCTCTGCACAACCACTACACGCAGAAGAGCCTC
TCCCTGTCTCCGGGTAAATGA
```

Amino Acid Sequence (SEQ ID NO: 492)

```
EVQLVESGGGLVQPGKSLKLSCEASGFTFSGYGMHWVRQAPGRGLESVAYITSSSINIKYADAVKGRFTVSRDNAKN
LLFLQMNILKSEDTAMYYCARFDWDKNYWGQGTMVTVSSGGGGSGGGSGGSGGGSGGGGSDIQMTQSPSSLPASLGD
RVTINCQASQDISNYLNWYQQKPGKAPKLLIYYTNKLADGVPSRFSGSGSGRDSSFTISSLESEDIGSYYCQQYYNY
PWTFGPGTKLEIKRGGGGSQVQLKQSGPGLVQPSQSLSITCTVSGFSLTNYGVHWVRQSPGKGLEWLGVIWSGGNTD
YNTPFTSRLSINKDNSKSQVFFKMNSLQSQDTAIYYCARALTYYDYEFAYWGQGTLVTVSAASTKGPSVFPLAPSSK
STSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPPCPAPELLGGPSVFLFPPKPKDTLMISRTPEVTCVVVDVSHEDPEVKFNWYVDGVEVHNA
KTKPREEQYQSTYRVVSVLTVLHQDWLNGKEYKCKVSNKALPAPIEKTISKAKGQPREPQVYTLPPSREEMTKNQVS
LTCLVKGFYPSDIAVEWESNGQPENNYKTTPPVLDSDGSFFLYSKLTVDKSRWQQGNVFSCSVMHEALHNHYTQKSL
SLSPGK*
```

OPP021: LC C225
Nucleotide Sequence (SEQ ID NO: 457)

```
GATATCTTGCTGACCCAGAGCCCGGTGATTCTGAGCGTGAGCCCGGGCGAACGTGTGAGCTTTAGCTGCCGCGCGAG
CCAGAGCATTGGCACCAACATTCATTGGTATCAGCAGCGCACCAACGGCAGCCCGCGCCTGCTGATTAAATATGCGA
GCGAAAGCATTAGCGGCATTCCGAGCCGCTTTAGCGGCAGCGGCAGCGGCACCGATTTTACCCTGAGCATTAACAGC
GTGGAAAGCGAAGATATTGCGGATTATTATTGCCAGCAGAACAACAACTGGCCGACCACCTTTGGCGCGGGCACCAA
ACTGGAAATCAAACGTACGGTGGCTGCACCATCTGTCTTCATCTTCCCGCCATCTGATGAGCAGTTGAAATCTGGAA
CTGCCTCTGTTGTGTGCCTGCTGAATAACTTCTATCCCAGAGAGGCCAAAGTACAGTGGAAGGTGGATAACGCCCTC
CAATCGGGTAACTCCCAGGAGAGTGTCACAGAGCAGGACAGCAAGGACAGCACCTACAGCCTCAGCAGCACCCTGAC
GCTGAGCAAAGCAGACTACGAGAAACACAAAGTCTACGCCTGCGAAGTCACCCATCAGGGCCTGAGCTCGCCCGTCA
CAAAGAGCTTCAACAGGGGAGAGTGTTAG
```

Amino Acid Sequence (SEQ ID NO: 458)

DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLEIKRTVAAPSVFIFPPSDEQLKSGTASVVCLLNNFYPREAKVQWKVDNAL

QSGNSQESVTEQDSKDSTYSLSSTLTLSKADYEKHKVYACEVTHQGLSSPVTKSFNRGEC*

CI053: 3954-1204-C225v5N297Q-MC01-2001-mCD3-H-N
pLW117: HC C225v5N297Q-MC01-2001-mCD3-H-N
Nucleotide Sequence
[spacer (SEQ ID NO: 507)][pLW117 without spacer (SEQ ID NO: 531)]

(SEQ ID NO: 493)

[CAAGGCCAGTCTGGCCAA][TTGCATCCTATGTGCCATCCTGAGGGTCTGTGCAAGTTTACTCCTGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]

Amino Acid Sequence
[spacer (SEQ ID NO: 87)][pLW117 without spacer (SEQ ID NO: 532)]

(SEQ ID NO: 494)

[QGQSGQ][LHPMCHPEGLCKFTPGGGSSGGSGGSGGISSGLLSGRSDNHGGGSEVQLVESGGGLVQPGKSLKLSCE

ASGFTFSGYGMHWVRQAPGRGLESVAYITSSSINIKYADAVKGRFTVSRDNAKNLLFLQMNILKSEDTAMYYCARFD

-continued

```
WDKNYWGQGTMVTVSSGGGGSGGGSGGSGGGSGGGGSDIQMTQSPSSLPASLGDRVTINCQASQDISNYLNWYQQKP

GKAPKLLIYYTNKLADGVPSRFSGSGSGRDSSFTISSLESEDIGSYYCQQYYNYPWTFGPGTKLEIKRGGGGSQVQL

KQSGPGLVQPSQSLSITCTVSGFSLTNYGVHWVRQSPGKGLEWLGVIWSGGNTDYNTPFTSRLSINKDNSKSQVFFK

MNSLQSQDTAIYYCARALTYYDYEFAYWGQGTLVTVSAASTKGPSVFPLAPSSKSTSGGTAALGCLVKDYFPEPVTV

SWNSGALTSGVHTFPAVLQSSGLYSLSSVVTVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVDGVEVHNAKTKPREEQYQSTYRVVSVLTVLH

QDWLNGKEYKCKVSNKALPAPIEKTISKAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
                                                                    (SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]
                                                                    (SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI054: 3954-1204-C225v5N297Q-MCO2-2001-mCD3-H-N
pLW118: HC C225v5N297Q-MCO2-2001-mCD3-H-N
Nucleotide Sequence
[spacer (SEQ ID NO: 521)][pLW118 without spacer (SEQ ID NO: 533)]
                                                                    (SEQ ID NO: 495)
[CAAGGCCAGTCTGGCCAAGGT][GCTTGCTCTGATATGGTTTATTGGGGTTCGTGCAGTTGGTTGGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCCTGGACCTTCGGCCCTGGCACCAAGCTGGAAATCAAAAGAGGAGGTGGTGGATCCCAGGTGCAGCTGAAACAG
```

```
AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]

Amino Acid Sequence
[spacer (SEQ ID NO: 407)][pLW118 without spacer (SEQ ID NO: 534)]
                                                                  (SEQ ID NO: 496)
[QGQSGQG][ACSDMVYWGSCSWLGGGSSGGSGGSGGISSGLLSGRSDNHGGGSEVQLVESGGGLVQPGKSLKLSCE

ASGFTFSGYGMHWVRQAPGRGLESVAYITSSSINIKYADAVKGRFTVSRDNAKNLLFLQMNILKSEDTAMYYCARFD

WDKNYWGQGTMVTVSSGGGGSGGGGSGGSGGGSGGGGSDIQMTQSPSSLPASLGDRVTINCQASQDISNYLNWYQQKP

GKAPKLLIYYTNKLADGVPSRFSGSGSGRDSSFTISSLESEDIGSYYCQQYYNYPWTFGPGTKLEIKRGGGGSQVQL

KQSGPGLVQPSQSLSITCTVSGFSLTNYGVHWVRQSPGKGLEWLGVIWSGGNTDYNTPFTSRLSINKDNSKSQVFFK

MNSLQSQDTAIYYCARALTYYDYEFAYWGQGTLVTVSAASTKGPSVFPLAPSSKSTSGGTAALGCLVKDYFPEPVTV

SWNSGALTSGVHTFPAVLQSSGLYSLSSVVTVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVDGVEVHNAKTKPREEQYQSTYRVVSVLTVLH

QDWLNGKEYKCKVSNKALPAPIEKTISKAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
                                                                  (SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA
```

-continued

```
GCAGACTACGAGAAACACAAAGTCTACGCCTGCGAAGTCACCCATCAGGGCCTGAGCTCGCCCGTCACAAAGAGCTT

CAACAGGGGAGAGTGTTAG]
```

Amino Acid Sequence
[spacer (SEQ ID NO: 87)][OPP022 without spacer (SEQ ID NO: 508)]

(SEQ ID NO: 450)

```
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*
```

CI055: 3954-1204-C225v5N297Q-MC03-2001-mCD3-H-N
pLW119: HC C225v5N297Q-MC03-2001-mCD3-H-N
Nucleotide Sequence
[spacer (SEQ ID NO: 507)][pLW119 without spacer (SEQ ID NO: 535)]

(SEQ ID NO: 497)

```
[CAAGGCCAGTCTGGCCAA][GATTGCATTGGATTGGATCATTATTTTCTTGGACCGTGCAGTTCTGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCTGGACCTTCGGCCCTGGCACCAAGCTGGAAATCAAAAGAGGAGGTGGTGGATCCCAGGTGCAGCTGAAACAG

AGCGGCCCCGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]
```

-continued

Amino Acid Sequence
[spacer (SEQ ID NO: 87)][pLW119 without spacer (SEQ ID NO: 536)]
(SEQ ID NO: 498)
[QGQSGQ][DCIGLDHYFLGPCSSGGGSSGGSGGSGGISSGLLSGRSDNHGGGSEVQLVESGGGLVQPGKSLKLSCE
ASGFTFSGYGMHWVRQAPGRGLESVAYITSSSINIKYADAVKGRFTVSRDNAKNLLFLQMNILKSEDTAMYYCARFD
WDKNYWGQGTMVTVSSGGGGSGGGGSGGSGGGSGGGGSDIQMTQSPSSLPASLGDRVTINCQASQDISNYLNWYQQKP
GKAPKLLIYYTNKLADGVPSRFSGSGSGRDSSFTISSLESEDIGSYYCQQYYNYPWTFGPGTKLEIKRGGGGSQVQL
KQSGPGLVQPSQSLSITCTVSGFSLTNYGVHWVRQSPGKGLEWLGVIWSGGNTDYNTPFTSRLSINKDNSKSQVFFK
MNSLQSQDTAIYYCARALTYYDYEFAYWGQGTLVTVSAASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPE
LLGGPSVFLFPPKPKDTLMISRTPEVTCVVVDVSHEDPEVKFNWYVDGVEVHNAKTKPREEQYQSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)
[CAAGGCCAGTCTGGCCAG][TGCATCTCACCTCGTGGTTGTCCGGACGGCCCATACGTCATGTACGGCTCGAGCGG
TGGCAGCGGTGGCTCTGGTGGATCCGGTCTGAGCGGCCGTTCCGATAATCATGGCAGTAGCGGTACCCAGATCTTGC
TGACCCAGAGCCCGGTGATTCTGAGCGTGAGCCCGGGCGAACGTGTGAGCTTTAGCTGCCGCGCGAGCCAGAGCATT
GGCACCAACATTCATTGGTATCAGCAGCGCACCAACGGCAGCCCGCGCCTGCTGATTAAATATGCGAGCGAAAGCAT
TAGCGGCATTCCGAGCCGCTTTAGCGGCAGCGGCAGCGGCACCGATTTTACCCTGAGCATTAACAGCGTGGAAAGCG
AAGATATTGCGGATTATTATTGCCAGCAGAACAACAACTGGCCGACCACCTTTGGCGCGGGCACCAAACTGGAACTG
AAACGTACGGTGGCTGCACCATCTGTCTTCATCTTCCCGCCATCTGATGAGCAGTTGAAATCTGGAACTGCCTCTGT
TGTGTGCCTGCTGAATAACTTCTATCCCAGAGAGGCCAAAGTACAGTGGAAGGTGGATAACGCCCTCCAATCGGTA
ACTCCCAGGAGAGTGTCACAGAGCAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTGAGCTCGCCCGTCACAAAGAGCTT
CAACAGGGGAGAGTGTTAG]

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ
SIGTNIHWYQQRTNGSPRLLIKYASESISGIPSRFSGSGSGTDFTLSINSVESEDIADYYCQQNNNWPTTFGAGTKL
ELKRTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC]*

CI056: 3954-1204-C225v5N297Q-MC04-2001-mCD3-H-N
pLW120: HC C225v5N297Q-MC04-2001-mCD3-H-N
Nucleotide Sequence
[spacer (SEQ ID NO: 507)][pLW120 without spacer (SEQ ID NO: 537)]
(SEQ ID NO: 499)
[CAAGGCCAGTCTGGCCAA][TCTATGTGCACTGAGCAGCAGTGGATTGTGAATCATTGCATTAGTGGAGGTGGCTC
GAGCGGTGGCAGCGGTGGCTCTGGTGGTATTAGCAGTGGTCTGTTAAGCGGTCGTAGCGATAATCATGGCGGCGGTT
CTGAAGTGCAGCTGGTGGAATCTGGGGGCGGACTGGTGCAGCCTGGCAAGTCTCTGAAGCTGAGCTGCGAGGCCAGC
GGCTTCACCTTTAGCGGCTACGGCATGCACTGGGTGCGCCAGGCACCTGGCAGAGGCCTGGAAAGCGTGGCCTACAT
CACCAGCAGCAGCATCAACATTAAGTACGCCGACGCCGTGAAGGGCCGGTTCACCGTGTCCAGAGACAACGCCAAGA
ACCTGCTGTTCCTGCAGATGAACATCCTGAAGTCCGAGGACACCGCCATGTACTACTGCGCCAGATTCGACTGGGAC
AAGAACTACTGGGGCCAGGGCACAATGGTCACAGTGTCCAGCGGTGGAGGTGGTAGTGGTGGAGGAAGTGGAGGTTC
AGGAGGTGGAAGCGGTGGTGGTGGTAGTGACATCCAGATGACCCAGAGCCCCAGCAGCCTGCCTGCCTCTCTGGGCG -continued

```
ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA
```

Amino Acid Sequence
[spacer (SEQ ID NO: 87)][pLW120 without spacer (SEQ ID NO: 538)]

(SEQ ID NO: 500)
[QGQSGQ][SMCTEQQWIVNHCISGGGSSGGSGGSGGISSGLLSGRSDNHGGGSEVQLVESGGGLVQPGKSLKLSCE
ASGFTFSGYGMHWVRQAPGRGLESVAYITSSSINIKYADAVKGRFTVSRDNAKNLLFLQMNILKSEDTAMYYCARFD
WDKNYWGQGTMVTVSSGGGGSGGGGSGGSGGGSGGGGSDIQMTQSPSSLPASLGDRVTINCQASQDISNYLNWYQQKP
GKAPKLLIYYTNKLADGVPSRFSGSGSGRDSSFTISSLESEDIGSYYCQQYYNYPWTFGPGTKLEIKRGGGGSQVQL
KQSGPGLVQPSQSLSITCTVSGFSLTNYGVHWVRQSPGKGLEWLGVIWSGGNTDYNTPFTSRLSINKDNSKSQVFFK
MNSLQSQDTAIYYCARALTYYDYEFAYWGQGTLVTVSAASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPE
LLGGPSVFLFPPKPKDTLMISRTPEVTCVVVDVSHEDPEVKFNWYVDGVEVHNAKTKPREEQYQSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]

(SEQ ID NO: 449)
```
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG
```

-continued

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI049: 3954-1204-C225v5N297Q-MC05-2001-mCD3-H-N
pLW121: HC C225v5N297Q-MC05-2001-mCD3-H-N
Nucleotide Sequence
[spacer (SEQ ID NO: 507)][pLW121 without spacer (SEQ ID NO: 539)]
(SEQ ID NO: 485)
[CAAGGCCAGTCTGGCCAA][ATTCATCCGATGTGCCATCCTGAGGGTGTTTGCGTTGCTCTGGATGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

-continued

```
AACTACAAGACCACGCCTCCCGTGCTGGACTCCGACGGCTCCTTCTTCCTCTACAGCAAGCTCACCGTGGACAAGAG
CAGGTGGCAGCAGGGGAACGTCTTCTCATGCTCCGTGATGCATGAGGCTCTGCACAACCACTACACGCAGAAGAGCC
TCTCCCTGTCTCCGGGTAAATGA]
```

```
Amino Acid Sequence
[spacer (SEQ ID NO: 87)][pLW121 without spacer (SEQ ID NO: 540)]
                                                                (SEQ ID NO: 486)
[QGQSGQ][IHPMCHPEGVCVALDGGGSSGGSGGSGGISSGLLSGRSDNHGGGSEVQLVESGGGLVQPGKSLKLSCE
ASGFTFSGYGMHWVRQAPGRGLESVAYITSSSINIKYADAVKGRFTVSRDNAKNLLFLQMNILKSEDTAMYYCARFD
WDKNYWGQGTMVTVSSGGGGSGGGGSGGSGGGSGGGGSDIQMTQSPSSLPASLGDRVTINCQASQDISNYLNWYQQKP
GKAPKLLIYYTNKLADGVPSRFSGSGSGRDSSFTISSLESEDIGSYYCQQYYNYPWTFGPGTKLEIKRGGGGSQVQL
KQSGPGLVQPSQSLSITCTVSGFSLTNYGVHWVRQSPGKGLEWLGVIWSGGNTDYNTPFTSRLSINKDNSKSQVFFK
MNSLQSQDTAIYYCARALTYYDYEFAYWGQGTLVTVSAASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPE
LLGGPSVFLFPPKPKDTLMISRTPEVTCVVVDVSHEDPEVKFNWYVDGVEVHNAKTKPREEQYQSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK]*
```

OPP022: LC C225 3954-1204
Nucleotide Sequence
[spacer (SEQ ID NO: 507)][OPP022 without spacer (SEQ ID NO: 509)]
(SEQ ID NO: 449)

```
[CAAGGCCAGTCTGGCCAG][TGCATCTCACCTCGTGGTTGTCCGGACGGCCCATACGTCATGTACGGCTCGAGCGG
TGGCAGCGGTGGCTCTGGTGGATCCGGTCTGAGCGGCCGTTCCGATAATCATGGCAGTAGCGGTACCCAGATCTTGC
TGACCCAGAGCCCGGTGATTCTGAGCGTGAGCCCGGGCGAACGTGTGAGCTTTAGCTGCCGCGCGAGCCAGAGCATT
GGCACCAACATTCATTGGTATCAGCAGCGCACCAACGGCAGCCCGCGCCTGCTGATTAAATATGCGAGCGAAAGCAT
TAGCGGCATTCCGAGCCGCTTTAGCGGCAGCGGCAGCGGCACCGATTTTACCCTGAGCATTAACAGCGTGGAAAGCG
AAGATATTGCGGATTATTATTGCCAGCAGAACAACAACTGGCCGACCACCTTTGGCGCGGGCACCAAACTGGAACTG
AAACGTACGGTGGCTGCACCATCTGTCTTCATCTTCCCGCCATCTGATGAGCAGTTGAAATCTGGAACTGCCTCTGT
TGTGTGCCTGCTGAATAACTTCTATCCCAGAGAGGCCAAAGTACAGTGGAAGGTGGATAACGCCCTCCAATCGGGTA
ACTCCCAGGAGAGTGTCACAGAGCAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTGAGCTCGCCCGTCACAAAGAGCTT
CAACAGGGGAGAGTGTTAG]
```

Amino Acid Sequence
[spacer (SEQ ID NO: 87)][OPP022 without spacer (SEQ ID NO: 508)]
(SEQ ID NO: 450)

```
[QGQSGQ][CISPRGCPDGPYVMYGSSGGSGGSGGSGLSGRSDNHGSSGTQILLTQSPVILSVSPGERVSFSCRASQ
SIGTNIHWYQQRTNGSPRLLIKYASESISGIPSRFSGSGSGTDFTLSINSVESEDIADYYCQQNNNWPTTFGAGTKL
ELKRTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC]*
```

CI050: 3954-1204-C225v5N297Q-MC06-2001-mCD3-H-N
pLW122: HC C225v5N297Q-MC06-2001-mCD3-H-N
Nucleotide Sequence
[spacer (SEQ ID NO: 507)][pLW122 without spacer (SEQ ID NO: 541)]
(SEQ ID NO: 487)

```
[CAAGGCCAGTCTGGCCAA][GATTGCTTTGTGCCTGGGTGGTATTTGGCGGGTCCGTGCGCTCAGGGAGGTGGCTC
GAGCGGTGGCAGCGGTGGCTCTGGTGGTATTAGCAGTGGTCTGTTAAGCGGTCGTAGCGATAATCATGGCGGCGGTT
CTGAAGTGCAGCTGGTGGAATCTGGGGGCGGACTGGTGCAGCCTGGCAAGTCTCTGAAGCTGAGCTGCGAGGCCAGC
GGCTTCACCTTTAGCGGCTACGGCATGCACTGGGTGCGCCAGGCACCTGGCAGAGGCCTGGAAAGCGTGGCCTACAT
CACCAGCAGCAGCATCAACATTAAGTACGCCGACGCCGTGAAGGGCCGGTTCACCGTGTCCAGAGACAACGCCAAGA
```

-continued

```
ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]
```

Amino Acid Sequence
[spacer (SEQ ID NO: 87)][pLW122 without spacer (SEQ ID NO: 542)]
(SEQ ID NO: 488)
[QGQSGQ][DCFVPGWYLAGPCAQGGGSSGGSGGSGGISSGLLSGRSDNHGGGSEVQLVESGGGLVQPGKSLKLSCE

ASGFTFSGYGMHWVRQAPGRGLESVAYITSSSINIKYADAVKGRFTVSRDNAKNLLFLQMNILKSEDTAMYYCARFD

WDKNYWGQGTMVTVSSGGGGSGGGSGGSGGSGGGGSDIQMTQSPSSLPASLGDRVTINCQASQDISNYLNWYQQKP

GKAPKLLIYYTNKLADGVPSRFSGSGSGRDSSFTISSLESEDIGSYYCQQYYNYPWTFGPGTKLEIKRGGGGSQVQL

KQSGPGLVQPSQSLSITCTVSGFSLTNYGVHWVRQSPGKGLEWLGVIWSGGNTDYNTPFTSRLSINKDNSKSQVFFK

MNSLQSQDTAIYYCARALTYYDYEFAYWGQGTLVTVSAASTKGPSVFPLAPSSKSTSGGTAALGCLVKDYFPEPVTV

SWNSGALTSGVHTFPAVLQSSGLYSLSSVVTVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVDGVEVHNAKTKPREEQYQSTYRVVSVLTVLH

QDWLNGKEYKCKVSNKALPAPIEKTISKAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

-continued

```
TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]
```

```
Amino Acid Sequence
[spacer (SEQ ID NO: 87)][OPP022 without spacer (SEQ ID NO: 508)]
                                                              (SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*
```

```
CI051: 3954-1204-C225v5N297Q-MC07-2001-mCD3-H-N
pLW123: HC C225v5N297Q-MC07-2001-mCD3-H-N
Nucleotide Sequence
[spacer (SEQ ID NO: 521)][pLW123 without spacer (SEQ ID NO: 543)]
                                                              (SEQ ID NO: 489)
[CAAGGCCAGTCTGGCCAAGGT][GTGTGCCATTCTCGGTTGGAGTGGCTTCTGGGTTGCCAAGGAGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG
```

-continued

```
CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]
```

Amino Acid Sequence
[spacer (SEQ ID NO: 407)][pLW123 without spacer (SEQ ID NO: 544)]
(SEQ ID NO: 490)
[QGQSGQG][VCHSRLEWLLGCQGGGGSSGGGSGGSGGISSGLLSGRSDNHGGGSEVQLVESGGGLVQPGKSLKLSCE

ASGFTFSGYGMHWVRQAPGRGLESVAYITSSSINIKYADAVKGRFTVSRDNAKNLLFLQMNILKSEDTAMYYCARFD

WDKNYWGQGTMVTVSSGGGGSGGGGSGGSGGGSGGGGSDIQMTQSPSSLPASLGDRVTINCQASQDISNYLNWYQQKP

GKAPKLLIYYTNKLADGVPSRFSGSGSGRDSSFTISSLESEDIGSYYCQQYYNYPWTFGPGTKLEIKRGGGGSQVQL

KQSGPGLVQPSQSLSITCTVSGFSLTNYGVHWVRQSPGKGLEWLGVIWSGGNTDYNTPFTSRLSINKDNSKSQVFFK

MNSLQSQDTAIYYCARALTYYDYEFAYWGQGTLVTVSAASTKGPSVFPLAPSSKSTSGGTAALGCLVKDYFPEPVTV

SWNSGALTSGVHTFPAVLQSSGLYSLSSVVTVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVDGVEVHNAKTKPREEQYQSTYRVVSVLTVLH

QDWLNGKEYKCKVSNKALPAPIEKTISKAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
(SEQ ID NO: 449)

```
[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]
```

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

-continued

```
CI057: 3954-1204-C225v5N297Q-MC08-2001-mCD3-H-N
pLW124: HC C225v5N297Q-MC08-2001-mCD3-H-N
Nucleotide Sequence
[spacer (SEQ ID NO: 507)][pLW124 without spacer (SEQ ID NO: 545)]
                                                                 (SEQ ID NO: 501)
[CAAGGCCAGTCTGGCCAA][GTGGGTGAGTGCGTTCCGGGTCCGCATGGGTGCTGGATGGCTTATGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

GGGCCAGGGCACCCTGGTGACCGTGAGCGCGGCTAGCACCAAGGGCCCATCGGTCTTCCCCCTGGCACCCTCCTCCA

AGAGCACCTCTGGGGGCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACTCTACTCCCTCAGCAG

CGTGGTGACCGTGCCCTCCAGCAGCTTGGGCACCCAGACCTACATCTGCAACGTGAATCACAAGCCCAGCAACACCA

AGGTGGACAAGAAAGTTGAGCCCAAATCTTGTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATG

CGTGGTGGTGGACGTGAGCCACGAAGACCCTGAGGTCAAGTTCAACTGGTACGTGGACGGCGTGGAGGTGCATAATG

CCAAGACAAAGCCGCGGGAGGAGCAGTACCAGAGCACGTACCGTGTGGTCAGCGTCCTCACCGTCCTGCACCAGGAC

TGGCTGAATGGCAAGGAGTACAAGTGCAAGGTCTCCAACAAAGCCCTCCCAGCCCCCATCGAGAAAACCATCTCCAA

AGCCAAAGGGCAGCCCCGAGAACCACAGGTGTACACCCTGCCCCCATCCCGGGAGGAGATGACCAAGAACCAGGTCA

GCCTGACCTGCCTGGTCAAAGGCTTCTATCCCAGCGACATCGCCGTGGAGTGGGAGAGCAATGGGCAGCCGGAGAAC

AACTACAAGACCACGCCTCCCGTGCTGGACTCCGACGGCTCCTTCTTCCTCTACAGCAAGCTCACCGTGGACAAGAG

CAGGTGGCAGCAGGGGAACGTCTTCTCATGCTCCGTGATGCATGAGGCTCTGCACAACCACTACACGCAGAAGAGCC

TCTCCCTGTCTCCGGGTAAATGA]

Amino Acid Sequence
[spacer (SEQ ID NO: 87)][pLW124 without spacer (SEQ ID NO: 546)]
                                                                 (SEQ ID NO: 502)
[QGQSGQ][VGECVPGPHGCWMAYGGGSSGGSGGSGGISSGLLSGRSDNHGGGSEVQLVESGGGLVQPGKSLKLSCE

ASGFTFSGYGMHWVRQAPGRGLESVAYITSSSINIKYADAVKGRFTVSRDNAKNLLFLQMNILKSEDTAMYYCARFD

WDKNYWGQGTMVTVSSGGGGSGGGSGGSGGGSGGGGSDIQMTQSPSSLPASLGDRVTINCQASQDISNYLNWYQQKP

GKAPKLLIYYTNKLADGVPSRFSGSGSGRDSSFTISSLESEDIGSYYCQQYYNYPWTFGPGTKLEIKRGGGGSQVQL

KQSGPGLVQPSQSLSITCTVSGFSLTNYGVHWVRQSPGKGLEWLGVIWSGGNTDYNTPFTSRLSINKDNSKSQVFFK

MNSLQSQDTAIYYCARALTYYDYEFAYWGQGTLVTVSAASTKGPSVFPLAPSSKSTSGGTAALGCLVKDYFPEPVTV
```

-continued

SWNSGALTSGVHTFPAVLQSSGLYSLSSVVTVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVDGVEVHNAKTKPREEQYQSTYRVVSVLTVLH

QDWLNGKEYKCKVSNKALPAPIEKTISKAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]

(SEQ ID NO: 449)

[CAAGGCCAGTCTGGCCAG][TGCATCTCACCTCGTGGTTGTCCGGACGGCCCATACGTCATGTACGGCTCGAGCGG

TGGCAGCGGTGGCTCTGGTGGATCCGGTCTGAGCGGCCGTTCCGATAATCATGGCAGTAGCGGTACCCAGATCTTGC

TGACCCAGAGCCCGGTGATTCTGAGCGTGAGCCCGGGCGAACGTGTGAGCTTTAGCTGCCGCGCGAGCCAGAGCATT

GGCACCAACATTCATTGGTATCAGCAGCGCACCAACGGCAGCCCGCGCCTGCTGATTAAATATGCGAGCGAAAGCAT

TAGCGGCATTCCGAGCCGCTTTAGCGGCAGCGGCAGCGGCACCGATTTTACCCTGAGCATTAACAGCGTGGAAAGCG

AAGATATTGCGGATTATTATTGCCAGCAGAACAACAACTGGCCGACCACCTTTGGCGCGGGCACCAAACTGGAACTG

AAACGTACGGTGGCTGCACCATCTGTCTTCATCTTCCCGCCATCTGATGAGCAGTTGAAATCTGGAACTGCCTCTGT

TGTGTGCCTGCTGAATAACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCACCCTGACGCTGAGCAAA

GCAGACTACGAGAAACACAAAGTCTACGCCTGCGAAGTCACCCATCAGGGCCTGAGCTCGCCCGTCACAAAGAGCTT

CAACAGGGGAGAGTGTTAG]

Amino Acid Sequence
[spacer (SEQ ID NO: 87)][OPP022 without spacer (SEQ ID NO: 508)]

(SEQ ID NO: 450)

[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI058: 3954-1204-C225v5N297Q-MC09-2001-mCD3-H-N
pLW125: HC C225v5N297Q-MC09-2001-mCD3-H-N
Nucleotide Sequence
[spacer (SEQ ID NO: 507)][pLW125 without spacer (SEQ ID NO: 475)]

(SEQ ID NO: 503)

[CAAGGCCAGTCTGGCCAA][TGGACGTGCGGAGGTATGGTGTATCTTGCGGGATTCTGCATGGCGGGAGGTGGCTC

GAGCGGTGGCAGCGGTGGCTCTGGTGGTATTAGCAGTGGTCTGTTAAGCGGTCGTAGCGATAATCATGGCGGCGGTT

CTGAAGTGCAGCTGGTGGAATCTGGGGGCGGACTGGTGCAGCCTGGCAAGTCTCTGAAGCTGAGCTGCGAGGCCAGC

GGCTTCACCTTTAGCGGCTACGGCATGCACTGGGTGCGCCAGGCACCTGGCAGAGGCCTGGAAAGCGTGGCCTACAT

CACCAGCAGCAGCATCAACATTAAGTACGCCGACGCCGTGAAGGGCCGGTTCACCGTGTCCAGAGACAACGCCAAGA

ACCTGCTGTTCCTGCAGATGAACATCCTGAAGTCCGAGGACACCGCCATGTACTACTGCGCCAGATTCGACTGGGAC

AAGAACTACTGGGGCCAGGGCACAATGGTCACAGTGTCCAGCGGTGGAGGTGGTAGTGGTGGAGGAAGTGGAGGTTC

AGGAGGTGGAAGCGGTGGTGGTGGTAGTGACATCCAGATGACCCAGAGCCCCAGCAGCCTGCCTGCCTCTCTGGGCG

ATAGAGTGACCATCAACTGCCAGGCCAGCCAGGACATCAGCAACTACCTGAACTGGTATCAGCAGAAGCCCGGCAAG

GCCCCCAAGCTGCTGATCTACTACACCAACAAGCTGGCCGACGGTGTGCCCAGCAGATTCAGCGGCAGCGGTAGCGG

CAGAGACAGCAGCTTCACCATCAGCTCCCTGGAATCCGAGGATATCGGCAGCTACTACTGCCAGCAGTACTACAACT

ACCCCCTGGACCTTCGGCCCTGGCACCAAGCTGGAAATCAAAAGAGGAGGTGGTGGATCCCAGGTGCAGCTGAAACAG

AGCGGCCCGGGCCTGGTGCAGCCGAGCCAGAGCCTGAGCATTACCTGCACCGTGAGCGGCTTTAGCCTGACCAACTA

TGGCGTGCATTGGGTGCGCCAGAGCCCGGGCAAAGGCCTGGAATGGCTGGGCGTGATTTGGAGCGGCGGCAACACCG

ATTATAACACCCCGTTTACCAGCCGCCTGAGCATTAACAAAGATAACAGCAAAAGCCAGGTGTTTTTTAAAATGAAC

AGCCTGCAAAGCCAGGATACCGCGATTTATTATTGCGCGCGCGCGCTGACCTATTATGATTATGAATTTGCGTATTG

-continued

```
GGGCCAGGGCACCCTGGTGACCGTGAGCGCGGCTAGCACCAAGGGCCCATCGGTCTTCCCCCTGGCACCCTCCTCCA
AGAGCACCTCTGGGGGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTCTACTCCCTCAGCAG
CGTGGTGACCGTGCCCTCCAGCAGCTTGGGCACCCAGACCTACATCTGCAACGTGAATCACAAGCCCAGCAACACCA
AGGTGGACAAGAAAGTTGAGCCCAAATCTTGTGACAAAACTCACACATGCCCACCGTGCCCAGCACCTGAACTCCTG
GGGGGACCGTCAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGGAGGTGCATAATG
CCAAGACAAAGCCGCGGGAGGAGCAGTACCAGAGCACGTACCGTGTGGTCAGCGTCCTCACCGTCCTGCACCAGGAC
TGGCTGAATGGCAAGGAGTACAAGTGCAAGGTCTCCAACAAAGCCCTCCCAGCCCCCATCGAGAAAACCATCTCCAA
AGCCAAAGGGCAGCCCCGAGAACCACAGGTGTACACCCTGCCCCCATCCCGGGAGGAGATGACCAAGAACCAGGTCA
GCCTGACCTGCCTGGTCAAAGGCTTCTATCCCAGCGACATCGCCGTGGAGTGGGAGAGCAATGGGCAGCCGGAGAAC
AACTACAAGACCACGCCTCCCGTGCTGGACTCCGACGGCTCCTTCTTCCTCTACAGCAAGCTCACCGTGGACAAGAG
CAGGTGGCAGCAGGGGAACGTCTTCTCATGCTCCGTGATGCATGAGGCTCTGCACAACCACTACACGCAGAAGAGCC
TCTCCCTGTCTCCGGGTAAATGA]

Amino Acid Sequence
[spacer (SEQ ID NO: 87)][pLW087 without spacer (SEQ ID NO: 476)]
                                                                     (SEQ ID NO: 504)
[QGQSGQ][WTCGGMVYLAGFCMAGGGSSGGSGGSGGISSGLLSGRSDNHGGGSEVQLVESGGGLVQPGKSLKLSCE
ASGFTFSGYGMHWVRQAPGRGLESVAYITSSSINIKYADAVKGRFTVSRDNAKNLLFLQMNILKSEDTAMYYCARFD
WDKNYWGQGTMVTVSSGGGGSGGGGSGGSGGGSGGGGSDIQMTQSPSSLPASLGDRVTINCQASQDISNYLNWYQQKP
GKAPKLLIYYTNKLADGVPSRFSGSGSGRDSSFTISSLESEDIGSYYCQQYYNYPWTFGPGTKLEIKRGGGGSQVQL
KQSGPGLVQPSQSLSITCTVSGFSLTNYGVHWVRQSPGKGLEWLGVIWSGGNTDYNTPFTSRLSINKDNSKSQVFFK
MNSLQSQDTAIYYCARALTYYDYEFAYWGQGTLVTVSAASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPE
LLGGPSVFLFPPKPKDTLMISRTPEVTCVVVDVSHEDPEVKFNWYVDGVEVHNAKTKPREEQYQSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK]*

OPP022: LC C225 3954-1204
Nucleotide Sequence
[spacer (SEQ ID NO: 507)][OPP022 without spacer (SEQ ID NO: 509)]
                                                                     (SEQ ID NO: 449)
[CAAGGCCAGTCTGGCCAG][TGCATCTCACCTCGTGGTTGTCCGGACGGCCCATACGTCATGTACGGCTCGAGCGG
TGGCAGCGGTGGCTCTGGTGGATCCGGTCTGAGCGGCCGTTCCGATAATCATGGCAGTAGCGGTACCCAGATCTTGC
TGACCCAGAGCCCGGTGATTCTGAGCGTGAGCCCGGGCGAACGTGTGAGCTTTAGCTGCCGCGCGAGCCAGAGCATT
GGCACCAACATTCATTGGTATCAGCAGCGCACCAACGGCAGCCCGCGCCTGCTGATTAAATATGCGAGCGAAAGCAT
TAGCGGCATTCCGAGCCGCTTTAGCGGCAGCGGCAGCGGCACCGATTTTACCCTGAGCATTAACAGCGTGGAAAGCG
AAGATATTGCGGATTATTATTGCCAGCAGAACAACAACTGGCCGACCACCTTTGGCGCGGGCACCAAACTGGAACTG
AAACGTACGGTGGCTGCACCATCTGTCTTCATCTTCCCGCCATCTGATGAGCAGTTGAAATCTGGAACTGCCTCTGT
TGTGTGCCTGCTGAATAACTTCTATCCCAGAGAGGCCAAAGTACAGTGGAAGGTGGATAACGCCCTCCAATCGGGTA
ACTCCCAGGAGAGTGTCACAGAGCAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTGAGCTCGCCCGTCACAAAGAGCTT
CAACAGGGGAGAGTGTTAG]
```

-continued

Amino Acid Sequence
[spacer (SEQ ID NO: 87)][OPP022 without spacer (SEQ ID NO: 508)]
(SEQ ID NO: 450)
[QGQSGQ][CISPRGCPDGPYVMYGSSGGSGGSGGSGLSGRSDNHGSSGTQILLTQSPVILSVSPGERVSFSCRASQ

SIGTNIHWYQQRTNGSPRLLIKYASESISGIPSRFSGSGSGTDFTLSINSVESEDIADYYCQQNNNWPTTFGAGTKL

ELKRTVAAPSVFIFPPSDEQLKSGTASVVCLLNNFYPREAKVQWKVDNALQSGNSQESVTEQDSKDSTYSLSSTLTL

SKADYEKHKVYACEVTHQGLSSPVTKSFNRGEC]*

CI059: BiTE420
BiTE420
Nucleotide Sequence
(SEQ ID NO: 505)
GACATCTTGCTGACTCAGTCTCCAGTCATCCTGTCTGTGAGTCCAGGAGAAAGAGTCAGTTTCTCCTGCAGGGCCAG

TCAGAGCATTGGCACAAACATACACTGGTATCAGCAAAGAACAAATGGTTCTCCAAGGCTTCTCATAAAGTATGCTT

CTGAGTCTATCTCTGGGATCCCTTCCAGGTTTAGTGGCAGTGGATCAGGGACAGATTTTACTCTTAGCATCAACAGT

GTGGAGTCTGAAGATATTGCAGATTATTACTGTCAACAAAATAATAACTGGCCAACCACATTTGGTGCAGGAACAAA

GCTGGAACTGAAAGGTGGTGGTGGTTCTGGCGGCGGCGGCTCCGGTGGTGGTGGTTCTCAGGTGCAGCTGAAGCAGT

CAGGACCTGGCCTAGTGCAGCCCTCACAGAGCCTGTCCATCACCTGCACAGTCTCTGGTTTCTCATTAACTAACTAT

GGAGTACACTGGGTTCGCCAGTCTCCAGGAAAGGGTCTGGAGTGGCTGGGAGTGATATGGAGTGGTGGAAACACAGA

CTATAATACACCTTTCACATCCAGACTGAGCATCAACAAGGACAATTCCAAGAGCCAAGTTTTCTTTAAAATGAACA

GTCTGCAATCTAATGACACAGCCATATATTACTGTGCCAGAGCCCTGACCTATTATGACTACGAGTTCGCCTATTGG

GGTCAGGGAACCCTGGTTACCGTGTCTTCCGGAGGTGGTGGATCCGAGGTGCAGCTGGTCGAGTCTGGAGGAGGATT

GGTGCAGCCTGGAGGGTCATTGAAACTCTCATGTGCAGCCTCTGGATTCACCTTCAATAAGTACGCCATGAACTGGG

TCCGCCAGGCTCCAGGAAAGGGTTTGGAATGGGTTGCTCGCATAAGAAGTAAATATAATAATTATGCAACATATTAT

GCCGATTCAGTGAAAGACAGGTTCACCATCTCCAGAGATGATTCAAAAAACACTGCCTATCTACAAATGAACAACTT

GAAAACTGAGGACACTGCCGTGTACTACTGTGTGAGACATGGGAACTTCGGTAATAGCTACATATCCTACTGGGCTT

ACTGGGGCCAAGGGACTCTGGTCACCGTCTCCTCAGGTGGTGGTGGTTCTGGCGGCGGCGGCTCCGGTGGTGGTGGT

TCTCAGACTGTTGTGACTCAGGAACCTTCACTCACCGTATCACCTGGTGGAACAGTCACACTCACTTGTGGCTCCTC

GACTGGGGCTGTTACATCTGGCTACTACCCAAACTGGGTCCAACAAAAACCAGGTCAGGCACCCCGTGGTCTAATAG

GTGGGACTAAGTTCCTCGCCCCCGGTACTCCTGCCAGATTCTCAGGCTCCCTGCTTGGAGGCAAGGCTGCCCTCACC

CTCTCAGGGGTACAGCCAGAGGATGAGGCAGAATATTACTGTGCTCTATGGTACAGCAACCGCTGGGTGTTCGGTGG

AGGAACCAAACTGACTGTCCTACACCATCACCACCATCATCACCACTAG

Amino Acid Sequence
(SEQ ID NO: 506)
DILLTQSPVILSVSPGERVSFSCRASQSIGTNIHWYQQRTNGSPRLLIKYASESISGIPSRFSGSGSGTDFTLSINS

VESEDIADYYCQQNNNWPTTFGAGTKLELKGGGGSGGGGSGGGGSQVQLKQSGPGLVQPSQSLSITCTVSGFSLTNY

GVHWVRQSPGKGLEWLGVIWSGGNTDYNTPFTSRLSINKDNSKSQVFFKMNSLQSNDTAIYYCARALTYYDYEFAYW

GQGTLVTVSSGGGGSEVQLVESGGGLVQPGGSLKLSCAASGFTFNKYAMNWVRQAPGKGLEWVARIRSKYNNYATYY

ADSVKDRFTISRDDSKNTAYLQMNNLKTEDTAVYYCVRHGNFGNSYISYWAYWGQGTLVTVSSGGGGSGGGGSGGGG

SQTVVTQEPSLTVSPGGTVTLTCGSSTGAVTSGYYPNWVQQKPGQAPRGLIGGTKFLAPGTPARFSGSLLGGKAALT

LSGVQPEDEAEYYCALWYSNRWVFGGGTKLTVL*

Example 5. SP34 scFv-Fc Binding to CD3ε Positive Jurkat Cells

To determine if the SP34 scFv Fc fusions could bind to CD3ε positive Jurkat T cells, a flow cytometry-based binding assay was performed. Jurkat T cells (Clone E6-1, ATCC, TIB-152) were cultured in RPMI-1640+glutamax (Life Technologies, Catalog 72400-120), 10% Heat Inactivated-Fetal Bovine Serum (HI-FBS, Life Technologies, Catalog 10438-026), 100 U/ml penicillin, and 100 μg/ml streptomycin (Life Technologies, Catalog 15140-122) according to ATCC guidelines. Cells were harvested by centrifugation (200×g, 4° C., 5 min) and re-suspended in PBS supplemented with 2% HI-FBS (FACS Buffer). About 250,000

Jurkats per well were transferred to a 96-well U-bottom plate, harvested, and re-suspended in 50 μL of primary antibody. The starting concentration of antibody was 200 nM followed by 5-fold serial dilutions for a total of 8 concentrations. The following antibodies were tested: SP34 LvHv scFv Fc, SP34 HvLv scFv Fc, and SP34-2.

Cells were incubated at 4° C. with shaking for about 2 hours, harvested, and washed with 3×200 μL of FACS Buffer. Jurkats treated with the SP34 scFv-Fc fusions were resuspended in 50 μl Alexa Fluor 488 conjugated anti-Human IgG Fc (1:100 dilution, Jackson ImmunoResearch, Product 109-546-098). Cells treated with SP34-2 and mouse isotype were resuspended in 50 μl Alexa Fluor 647 conjugated Anti-mouse IgG (1:100 dilution, Jackson ImmunoResearch, Product 715-605-150). Jurkats were incubated at 4° C. with shaking for about 30 min, harvested, washed with 3×200 μL of FACS Buffer, and resuspended in a final volume of 120 μL of FACS Buffer. Samples were analyzed on a BD Accuri C6 (BD Biosciences) and the median fluorescence intensity (MFI) of viable cells was calculated using FlowJo V10 (Treestar). $EC_{50}$ values were calculated in GraphPad Prism 6 by curve fitting the data to log(agonist) vs. response (three parameters).

Figure 13A:
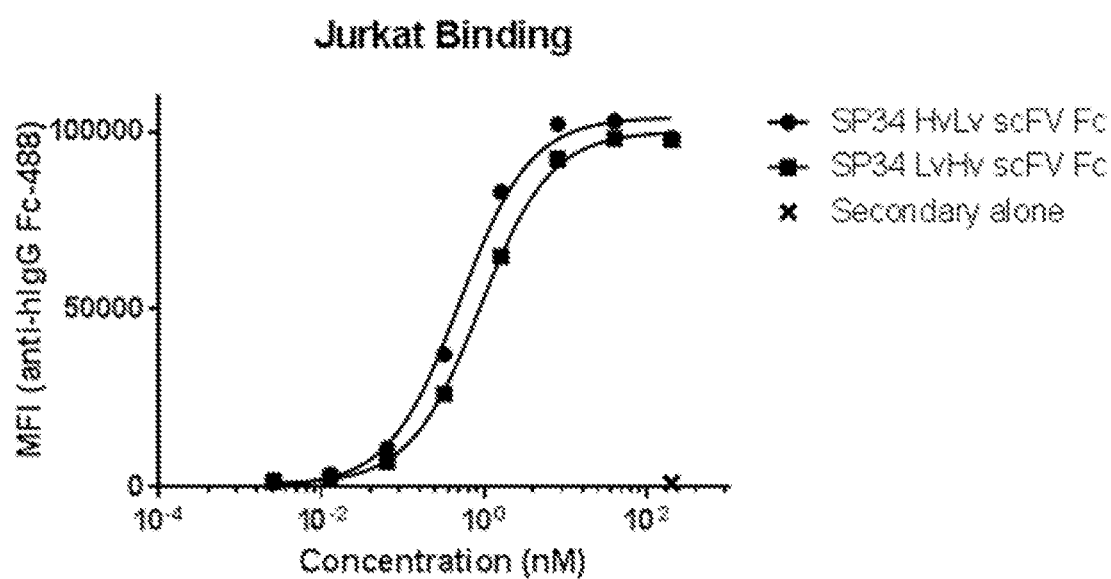
FIGS. 13A and 13B are a series of graphs depicting SP34 scFv-Fc binding to CD3ε positive Jurkat cells.
Figure 13B:
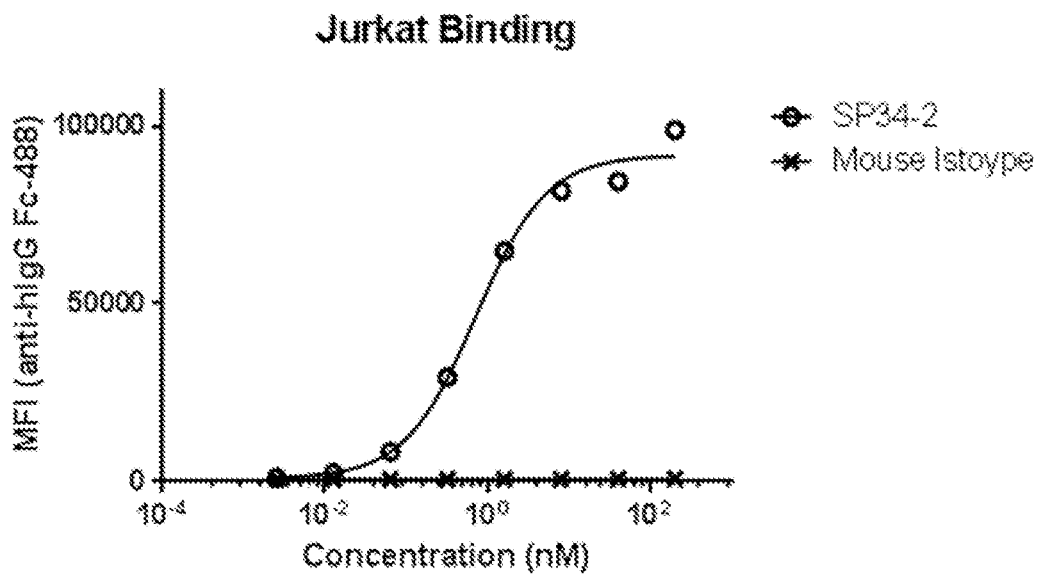

FIGS. 13A and 13B demonstrate that all the formats of SP34 bind to CD3ε Jurkat cells with similar $EC_{50}$ values.

Example 6. Binding of Activatable Anti-CD3ε Antibodies to CD3ε Jurkat Cells

To determine if the masking peptides described in the previous examples could inhibit binding in the SP34 scFv-Fc context, a flow cytometry-based binding assay was performed. Jurkat T cells were cultured and processed in FACS Buffer as described. About 100,000 Jurkats per well were transferred to a 96-well U-bottom plate, harvested, and re-suspended in 50 μL of primary antibody. Titrations started at either 1 μM or 333 nM followed by 3-fold serial dilutions in FACS Buffer. The following antibodies and activatable antibodies were tested: 15003 1204 SP34 LvHv Fc; 15860 1204 SP34 LvHv Fc; 15865 1204 SP34 LvHv, SP34 LvHv, 15003 1204 SP34 HvLv; 15860 1204 SP34 HvLv Fc; 15865 1204 SP34 HvLv, SP34 HvLv Fc, and mouse SP34.

Cells were incubated at 4° C. with shaking for about 1 hour, harvested, and washed with 3×200 μL of FACS Buffer. Jurkats treated with SP34 Fc fusions were resuspended in 50 μl of Alexa Fluor 647 conjugated anti-Human IgG Fc (1:100 dilution, Jackson ImmunoResearch, Product 109-606-008). Cells treated with mouse SP34 were resuspended in in 50 μl Alexa Fluor 647 conjugated Anti-mouse IgG (1:100 dilution, Jackson ImmunoResearch, Product 715-605-150). Jurkats were incubated at 4° C. with shaking for about 30 min, harvested, washed with 3×200 μL of FACS Buffer, and resuspended in a final volume of 100 μL of FACS Buffer containing 2.5 μg/ml 7-AAD (BD Biosciences, Catalog 559925). Samples were collected on a MACSQuant® Analyzer 10 (Miltenyi) and the median fluorescence intensity (MFI) of viable cells was calculated using FlowJo V10 (Treestar). $EC_{50}$ values were calculated in GraphPad Prism 6 by curve fitting the data to log(agonist) vs. response (three parameters).

Figure 14A:
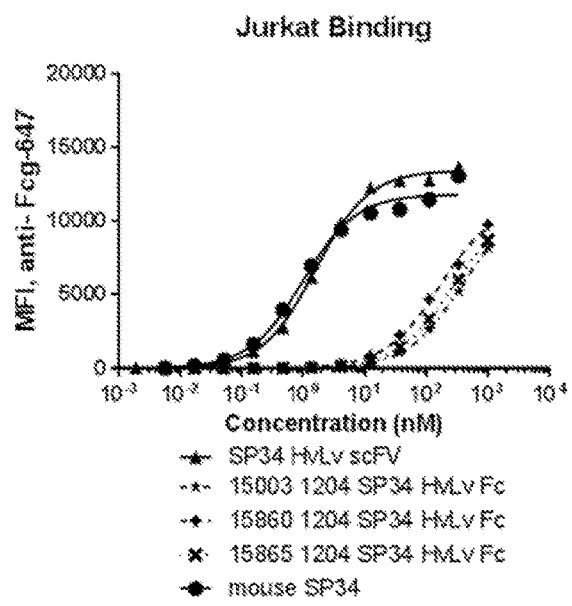
FIGS. 14A and 14B are a series of graphs depicting the ability of masking moieties of the disclosure to reduce the ability of activatable anti-CD3ε antibodies comprising such masking moieties to bind to CD3ε on Jurkat T cells.
Figure 14B:
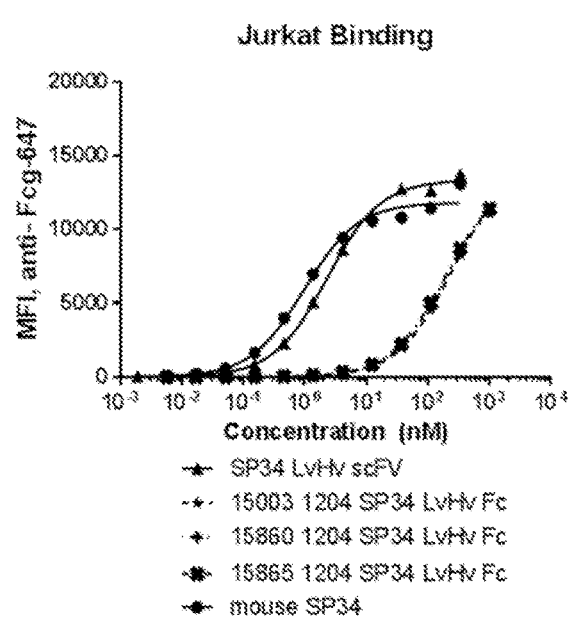

FIGS. 14A and 14B demonstrate that incorporation of the masking peptides into the SP34 scFv-Fc context to produce activatable antibodies shifted the $EC_{50}$ values for CD3ε binding from single digit to triple digit nM.

Example 7. Binding of Dually Masked Multispecific, Activatable Antibodies to EGFR+ HT-29 Cells and CD3ε+ Jurkat Cells To determine if the CD3ε masking peptides described in the previous examples could inhibit binding in the context of an EGFR masked multispecific, activatable antibody, a flow cytometry-based binding assay was performed.

EGFR+HT-29-luc2 (Caliper) were cultured in RPMI-1640+glutamax (Life Technologies, Catalog 72400-120), 10% Heat Inactivated-Fetal Bovine Serum (HI-FBS, Life Technologies, Catalog 10438-026), 100 U/ml penicillin, and 100 μg/ml streptomycin (Life Technologies, Catalog 15140-122) according to manufacturer guidelines. Cells were lifted with cell dissociation buffer (Sigma, Catalog C5789), washed, and re-suspended in 50 μL of primary antibody. Titrations started at the concentrations indicated in FIGS. 15A-15D followed by 3-fold serial dilutions in FACS Buffer. The following multispecific antibodies and multispecific, activatable antibodies were tested: CI005 (EGFR/hCD3), CI023 (M-EGFR/M-hCD3), CI024 (M-EGFR/M-hCD3), CI015 (EGFR/hCD3), CI011 (M-EGFR/M-hCD3), CI010 (M-EGFR/M-hCD3). Two versions of SP34 scFv are utilized, namely the scFv in CI005, CI023, CI024 versus the scFv in CI015, CI011, CI010. The binding specificity of the multispecific antibody is indicated by antigen name (in this example EGFR and CD3) and the letter M indicates masking of antigen binding.

HT29-luc2 cells were incubated at 4° C. with shaking for about 1 hour, harvested, and washed with 3×200 μL of FACS Buffer. Cells were resuspended in 50 μl of Alexa Fluor 647 conjugated anti-Human IgG Fc (1:100 dilution, Jackson ImmunoResearch, Product 109-606-008) and incubated at 4° C. with shaking for about 30 min. HT29-luc2 were harvested, washed with 3×200 μL of FACS Buffer, and resuspended in a final volume of 100 μL of FACS Buffer containing 2.5 μg/ml 7-AAD (BD Biosciences, Catalog 559925). Samples were collected on a MACSQuant® Analyzer 10 (Miltenyi) and the median fluorescence intensity (MFI) of viable cells was calculated using FlowJo V10 (Treestar). $EC_{50}$ values were calculated in GraphPad Prism 6 by curve fitting the data to log(agonist) vs. response (three parameters).

Binding of the multispecific antibodies and multispecific, activatable antibodies to CD3ε Jurkats were tested as previously described.

FIGS. 15A-15C demonstrate that incorporation of the CD3ε masking peptides into the EGFR masked multispecific activatable antibody shifted the $EC_{50}$ values for CD3ε binding from single digit to triple digit nM. This binding shift was evident in multispecific, activatable antibodies that utilize two versions of SP34 scFv (namely the scFv in CI005, CI023, CI024 versus the scFv in CI015, CI011, CI010). In addition, EGFR masking is still effective in the multispecific, activatable antibodies that are masked for both EGFR and CD3 binding.

Example 8. Cytotoxicity of Dually Masked Multispecific, Activatable Antibodies to EGFR+HT-29 Cells and CD3ε+ Jurkat Cells To determine if the CD3ε masking peptides described in the previous examples could function in the context of an EGFR masked multispecific, activatable antibody, a cytotoxicity assay was performed.

Human PBMCs were purchased as frozen aliquots (HemaCare, Catalog PB009C-1) or isolated from a buffy coat obtained from a healthy donor (Stanford Blood Center) via Ficoll density gradient centrifugation (REFERENCE=*Isolation of mononuclear cells and granulocytes from human blood*. Boyum, A., Scand. *J. Clin. Lab. Invest.* 21 Suppl, 97, 77-89 (1968)). Human PBMCs were co-cultured in RPMI-1640+glutamax, 5% heat inactivated human serum (Sigma, Catalog H3667), and 100 U/ml penicillin, and 100 µg/ml streptomycin in a white wall 96 well plates with EGFR-expressing HT29-luc2 cells at a PBMC to HT29-luc ratio of 10:1. Titrations of the following multispecific antibodies and multispecific, activatable antibodies were tested: CI005 (EGFR/hCD3), CI023 (M-EGFR/M-hCD3), CI024 (M-EGFR/M-hCD3), CI011 (M-EGFR/M-hCD3), CI010 (M-EGFR/M-hCD3). In addition, EGFR antibody (CI012) and isotype were used as negative controls at a single concentration. The total volume after addition of effector cells, target cells, and antibody was 150 µL. After 48 hours, the luminogenic peptide substrate of the CytoTox-Glo™ Cytotoxicity Assay (Promega) was added directly to the plates to measure released protease activity. Luminescence was measured 50 min after substrate addition on the Infinite M200 Pro (Tecan). Results were expressed in luminescence after background subtraction of untreated values and plotted in Prism with curve fitting analysis log(agonist) vs. response (three parameters).

FIGS. 16A and 16B demonstrate that the EGFR and CD3ε masked multispecific, activatable antibodies shift the cytotoxicity $EC_{50}$ relative to an unmasked control. This shift was evident in multispecific, activatable antibodies that utilize two versions of SP34 scFv, namely the scFv in CI023 and CI024 versus the scFv in CI011 and CI010.

Example 9. Binding of Singly and Dually Masked Multispecific, Activatable Antibodies to EGFR+HT-29 Cells and CD3ε+ Jurkat Cells To determine if the CD3ε and EGFR masks could attenuate binding in a multispecific, activatable antibody, a flow cytometry assay was performed. Binding to CD3ε+ Jurkat cells and EGFR+HT-29 cells was performed as previously described on the following multispecific antibody and multi specific, activatable antibodies: CI005 (EGFR/hCD3), CI007 (M-EGFR/hCD3), CI008 (EGFR/M1-hCD3), CI009 (EGFR/M2-hCD3), CI010 (M-EGFR/M1-hCD3), and CI011 (M-EGFR/M2-hCD3).

FIGS. 17A and 17B demonstrate that the EGFR mask can shift the $EC_{50}$ of EGFR binding in the presence (CI010, CI011) and absence (CI007) of the CD3ε masks. Both CD3ε masks can shift the $EC_{50}$ of CD3ε binding in the presence (CI010, CI011) and absence (CI008, C009) of the EGFR mask.

Example 10. EGFR Dependent Cytotoxicity of Singly and Dually Masked Multispecific, Activatable Antibodies To determine if the CD3ε and EGFR masks could attenuate cell killing in a multispecific, activatable antibody, a cytotoxicity assay was performed. EGFR dependent cell killing was evaluated by co-culturing PBMCs and EGFR+ HT-29 luc cells as previously described. EGFR independent cell killing was evaluated by co-culturing PBMCs with the EGFR negative U266 cell line (ATCC, Catalog TIB-196). U266 cells were cultured according to ATCC guidelines in RPMI-1640+glutamax, 10% Heat Inactivated-Fetal Bovine Serum, 100 U/ml penicillin, and 100 µg/ml streptomycin. Titrations of the following multispecific antibody and multispecific, activatable antibodies were tested: CI005 (EGFR/hCD3), CI007 (M-EGFR/hCD3), CI009 (EGFR/M2-hCD3), CI011 (M-EGFR/M2-hCD3). Co-culture conditions and quantification of cytotoxicity is described in the previous example.

FIGS. 18A and 18B demonstrate that killing of EGFR+ HT29-luc2 cells is maximally attenuated by masking both EGFR and CD3 binding in the multispecific, activatable antibody. In contrast, killing of EGFR negative U266 cells was undetectable in identical co-culture conditions.

Example 11. EGFR Dependent Primary T Cell Activation of Singly and Dually Masked Multispecific, Activatable Antibodies To determine if the CD3ε and EGFR masks could attenuate primary T cell activation in a multispecific, activatable antibody, a flow cytometry assay was performed. PBMC and EGFR+HT-29 luc2 co-culture conditions are described in the previous example. After a 24 hour incubation, the culture was transferred to a U-bottom plate and the remaining cells were detached with 0.25% trypsin (Life Technologies, Catalog 25200-056). Trypsin activity was quenched by adding 3 volumes of FACS Buffer, and the cell suspension was transferred to the same U-bottom plate. After harvesting, the cells were resuspended in 50 µL of either an anti-CD69 PE/Anti-CD8 APC-Vio770 cocktail (anti-CD69 PE, BD Biosciences, Catalog 555531; anti-CD8 APC-Vio770, Miltenyi Biotec, Catalog 130-096-561), APC-Vio770 isotype control (Miltenyi Biotec, Catalog 130-099-637), or PE isotype control (BD BioSciences, Catalog 340761). All antibodies were used at the manufacturer's recommended concentrations. Cells were stained for 1 h at 4° C. with shaking, harvested and re-suspended in a final volume of 100 µL FACS Buffer with 2.5 µg/ml 7-AAD. Samples were collected on a MACSQuant® Analyzer 10 (Miltenyi) and activation was quantified in FlowJo V10 (Treestar) as the percentage of CD8+ T cells with expression of CD69 above the PE isotype control. $EC_{50}$ values were calculated in GraphPad Prism 6 by curve fitting the data to log(agonist) vs. response (three parameters).

FIG. 19 demonstrates that activation of primary CD8+ T cells is maximally attenuated by masking both EGFR and CD3 binding in the multispecific, activatable antibody.

Example 12. EGFR Independent Primary T Cell Activation of Singly and Dually Masked Multispecific, Activatable Antibodies To determine if the CD3ε masks could attenuate EGFR independent activation in a multispecific, activatable antibody, a flow cytometry assay was performed. PBMC and EGFR negative U266 co-culture conditions are described in the previous example. Activation of primary CD8+ T cells was assessed by CD69 staining as previously described. The following multispecific antibody and multispecific, activatable antibodies were evaluated: CI005 (EGFR/hCD3), CI007 (M-EGFR/hCD3), CI009 (EGFR/M2-hCD3), CI011 (M-EGFR/M2-hCD3).

Figure 20A:
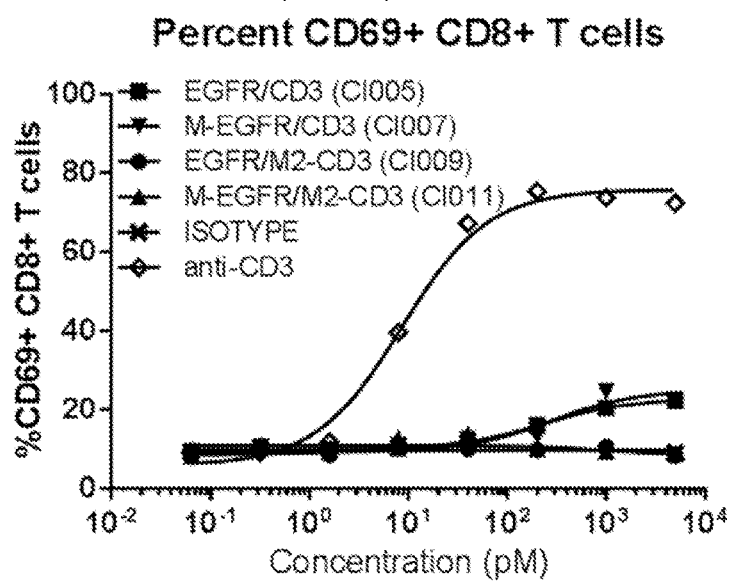
FIGS. 20A and 20B are a series of graphs depicting that CD3 masked multispecific antibodies show negligible target independent activation as evidenced by CD69+ frequency analysis shown in FIG. 20A and CD69 Mean Fluorescence Intensity analysis shown in FIG. 20B.
Figure 20B:
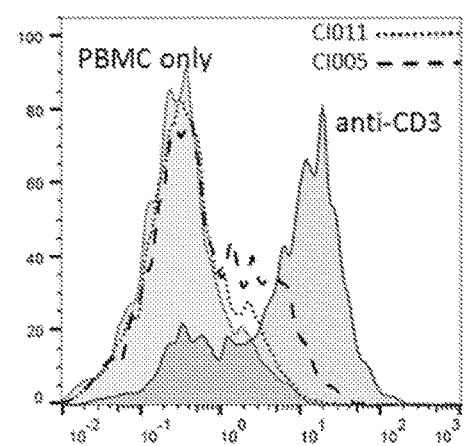

FIGS. 20A and 20B demonstrate that target-independent T cell activation by the unmasked bispecific antibody is only very minimal and that this low degree of activity is abrogated upon masking of the anti-CD3 moiety.

Example 13. uPA Digest of Multispecific, Activatable Antibodies Restores Binding to EGFR+HT-29 Luc2 Cells and CD3+ Jurkat Cells and Cytotoxicity Against EGFR+HT-29 Luc2 Cells Activation of the multispecific activatable antibody was conducted as follows: multispecific activatable antibodies in PBS was cleaved by the addition of uPA (R&D Systems, Catalog 1310-SE) to a final concentration of about 1 µM. The digest was incubated at 37° C. overnight, and cleavage was confirmed by removing an aliquot for capillary electrophoresis analysis (GX-II Capillary Electrophoresis, Perkin Elmer) or SDS-PAGE. Protease and the cleaved masking moiety were removed by Protein A purification. Briefly, the digested sample was diluted to 2 ml with PBS and loaded onto equilibrated MabSelect SuRe™ beads (GE Healthcare Life Sciences, Product 11-0026-01 AD). Beads were washed with 5 column volumes (CV) of 1×PBS, followed by 5 CV of 5×PBS supplemented with 5% isopropyl alcohol (IPA), and finally with 5 CV of 1×PBS. Antibody was eluted with 10 CV of 0.1 M Glycine, pH 3.0, and fractions were neutralized with 1 M Tris, pH 8.0, pooled, concentrated and buffer exchanged into PBS. Binding to CD3ε+ Jurkat cells and EGFR+HT-29 cells and cell killing against HT-29 luc2 cells was performed as previously described.

FIGS. 21A-21D demonstrate that uPA activation restores binding of the multispecific, activatable CI011 (M-EGFR/M-hCD3) antibody to both EGFR+HT29-luc2 cells and CD3+ Jurkat cells. In addition, cell killing of all multispecific, activatable antibodies is restored by uPA activation.

Example 14. Dually Masked Multispecific, Activatable Antibodies Incorporating Different Substrates To determine if different substrates impact EGFR dependent killing of dually masked, multispecific, activatable antibodies, a cytotoxicity assay was performed. Cell killing against HT-29 luc2 cells was performed as previously described.

FIG. 22 demonstrates that dually masked multispecific, activatable antibodies that contain different substrates shift $EC_{50}$ cytotoxicity.

Example 15. Multispecific Antibodies and Multispecific Activatable Antibodies of the Embodiments Prevent HT-29Luc2 Tumor Growth in Mice In this example, multispecific antibodies and multispecific activatable antibodies targeting EGFR and CD3ε were analyzed for ability to prevent growth of HT-29Luc2 xenograft tumors in immune-deficient NOD-scid mice.

The human colon cancer cell line HT-29Luc2 was obtained from Perkin Elmer, Inc., Waltham, Mass. (formerly Caliper Life Sciences, Inc.). The fresh, human PBMCs and PBMCs enriched for T cells were obtained from a human donor through Hemacare, Inc., Van Nuys, Calif. and shipped overnight to CytomX. The HT-29Luc2 cells were implanted subcutaneously along with human PBMCs or fresh PBMCs enriched for T cells into the right flank of NOD scid (NOD.CB17-Prkdc$^{scid}$/J) mice (Jackson Laboratory, Bar Harbor, Me.). The HT-29Luc2 cells were grown in McCoy's 5a medium (ATCC, Manassas, Va.), with 10% fetal bovine serum (Gibco-brand, ThermoFisher, Inc. Waltham, Mass.) at 37° C. in an atmosphere of 5% $CO_2$ in air. The tumor cells were routinely sub-cultured twice weekly. Cells were harvested during the logarithmic growth period and kept at ambient temperature for tumor induction.

In one prevention study, mice were inoculated subcutaneously with 100 µL of a cell suspension containing $2\times10^6$ tumor cells with or without $2\times10^6$ fresh, unstimulated PBMC (Day 0). On the same day, mice received a first dose of test or control article by intravenous injection (Day 0). Tumor volume was measured twice weekly in two dimensions using a digital caliper, and the volume was expressed in $mm^3$ using the formula: $V=0.5\ a\times b^2$ where a and b are the long and short diameters of the tumor, respectively.

The mice were grouped and dosed as set forth in Table 13.

TABLE 13

Groups and doses for HT-29Luc2 xenograft study.

| Group | Count | Tumor | PBMC | Treatment | Dose (mg/kg) | Schedule |
|---|---|---|---|---|---|---|
| 1 | 8 | HT-29Luc2 | — | PBS | — | q7dx2, iv |
| 2 | 8 | HT-29Luc2 | Donor A | PBS | — | q7dx2, iv |
| 3 | 8 | HT-29Luc2 | Donor A | CI005 | 0.10 | q7dx2, iv |
| 4 | 8 | HT-29Luc2 | Donor A | CI059 (BiTE) | 0.5* | qdx8, iv |

*BiTE was dosed at 0.5 mg/kg/day.

Figure 23:
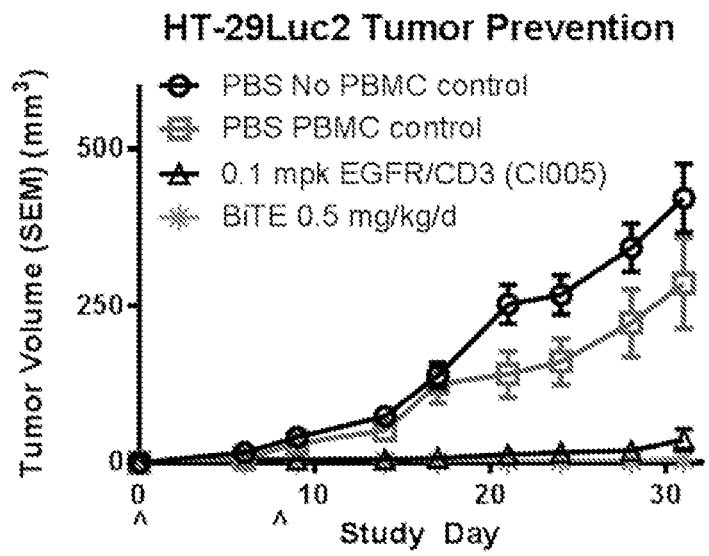
FIG. 23 is a graph depicting that bispecific antibody CI005 at 0.1 mg/kg dosed twice over 7 days and CI059 (BiTE) at 0.5 mg/kg/day for 8 days prevented the growth of HT-29Luc2 xenograft tumors.

FIG. 23, which plots tumor volume versus days post initial dose, demonstrated that multispecific antibody CI005 at 0.1 mg/kg dosed twice 7 days apart and CI059 (BiTE) at 0.5 mg/kg/day for 8 consecutive days prevented the growth of HT-29Luc2 xenograft tumors.

In a separate study, multispecific antibody CI048 and multispecific activatable antibody CI011 targeting EGFR and CD3ε were tested for the ability to prevent or inhibit the growth of HT-29Luc2 xenograft tumor using a method similar to that described above. Groups and doses are set forth in Table 14. The effector cells in this study were fresh, unstimulated CD3+ T cells enriched from PBMCs, and were co-injected in a 1:1 ratio of effector cell to tumor cell.

TABLE 14

Groups and doses for HT-29Luc2 xenograft prevention study.

| Group | Count | Tumor | Effector cells | Route/volume of Administration | Treatment | Dose (mg/kg) | Schedule |
|---|---|---|---|---|---|---|---|
| 1 | 8 | HT-29Luc2 | Donor A | SC, co-administration with tumor on d0 with IV administration of treatment 5 ml/kg | PBS | — | d0, d7 |
| 2 | 9 | HT-29Luc2 | Donor A | | CI048 | 0.10 | d0, d7 |
| 3 | 10 | HT-29Luc2 | Donor A | | CI011 | 0.10 | d0, d7 |

Figure 24:
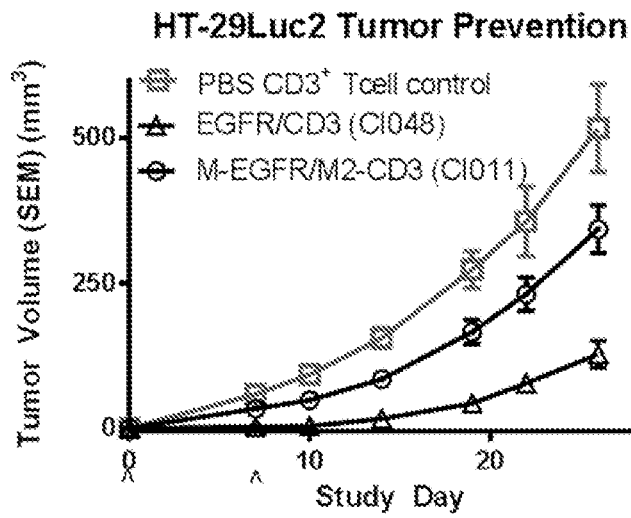
FIG. 24 is a graph depicting that CI048 antibody limited establishment of HT-29Luc2 xenograft tumors and CI011 inhibited the growth of HT-29Luc2 xenograft tumors. The difference in effect between PBS and CI011 is significant (p<0.05).

FIG. 24, which plots tumor volume versus days post initial dose, demonstrated that CI048 multispecific antibody limited establishment of HT-29Luc2 xenograft tumors and CI011 multispecific activatable antibody inhibited the growth of HT-29Luc2 xenograft tumors. The difference in effect between PBS and CI011 on Day 26 is statistically significant (p<0.05).

Example 16. Multispecific Antibodies and Multispecific Activatable Antibodies of the Embodiments Induced Regression of Established HT-29Luc2 Tumors in Mice In this example, multispecific antibodies and multispecific activatable antibodies targeting EGFR and CD3ε were analyzed for the ability to produce regression or reduced growth of established HT-29Luc2 xenograft tumors in human T-cell engrafted NSG mice.

The human colon cancer cell line HT-29Luc2 was obtained from Perkin Elmer, Inc., Waltham, Mass. (formerly Caliper Life Sciences, Inc.) and cultured as described in Example 15. Purified, frozen human PBMCs were obtained from a human donor through Hemacare, Inc., Van Nuys, Calif. NSG (NOD.Cg-Prkdcscid Il2rg$^{tm1Wjl}$/SzJ) mice were obtained from The Jackson Laboratories, Bar Harbor, Me.

In preparation for the tumor intervention study, each mouse was inoculated subcutaneously at the right flank with $2 \times 10^6$ HT-29Luc2 cells in 100 μL RPMI+Glutamax, serum-free medium. Previously frozen PBMCs from a single donor ("A") were analyzed to determine the percent CD3+ T cells. This value was used to calculate the total number of PBMCs needed to achieve a CD3+ T cell to tumor cell ratio of 2:1. This total number of PBMCs (10.2 million) was injected into the peritoneum of each mouse on the day of tumor cell implantation.

Blood (~100 μl) was collected from all mice 11 days post PBMC inoculation to evaluate extent of human T cell engraftment within each mouse by flow cytometry. Whole blood (anti-coagulant, lithium heparin) was assayed for presence of human CD3+ with percent CD4+ and CD8+ T cells.

Tumor volume and body weights were measured twice weekly and tumor volumes calculated as described in Example 15. 13 days after tumor inoculation, mice with adequate T cell engraftment and with tumors in the target size range (50-100 mm³; average ~70 mm³) were randomized into groups of 8. The following day, mice assigned to treatment groups were dosed IV (5 mL/kg) according to Table 15.

TABLE 15

Groups and doses for dose dependent HT-29Luc2 xenograft study.

| Group | Count | Tumor[1] | Effector cells[2,3] | Route of Administration Effector cells | Route of Administration compound | Treatment | Dose (mg/kg) | Schedule |
|---|---|---|---|---|---|---|---|---|
| 1 | 8 | HT-29Luc2 | 10.2 million/mouse | IP | IV | PBS | — | d1, d8, d15 |
| 2 | 8 | HT-29Luc2 | 10.2 million/mouse | | | CI048 | 0.003 | |
| 3 | 8 | HT-29Luc2 | 10.2 million/mouse | | | CI048 | 0.010 | |
| 4 | 8 | HT-29Luc2 | 10.2 million/mouse | | | CI048 | 0.030 | |
| 5 | 8 | HT-29Luc2 | 10.2 million/mouse | | | CI048 | 0.10 | |
| 6 | 8 | HT-29Luc2 | 10.2 million/mouse | | | CI048 | 0.30 | |
| 7 | 8 | HT-29Luc2 | 10.2 million/mouse | | | CI040 | 0.10 | |

[1] 2 million HT29-Luc2 cells were implanted.
[2] PBMC number were normalized to CD3+ number and with a ratio of 1:2 tumor:CD3+ T cell.
[3] frozen PBMCs were allowed to engraft without pre-stimulation for ~13 days.

Figure 25:
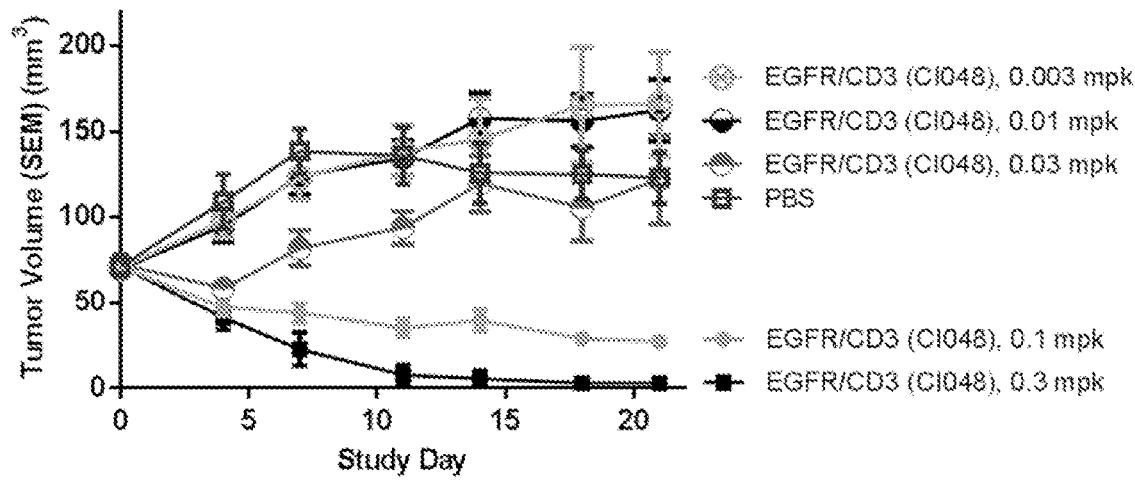
FIG. 25 is a graph depicting that a dose-response for the CI048 bispecific antibody for elimination of HT-29Luc2 xenograft tumors.

FIG. 25, which plots tumor volume versus days post initial treatment dose, demonstrated a dose-dependent effect of CI048 multispecific antibody on the growth of HT-29Luc2 xenograft tumors. The most efficacious dose of CI048 was 0.3 mg/kg, resulting in sustained, complete tumor regression in 100% mice. CI048 at 0.1 mg/kg was also highly efficacious, with a majority of mice exhibiting tumor regression.

Figure 26:
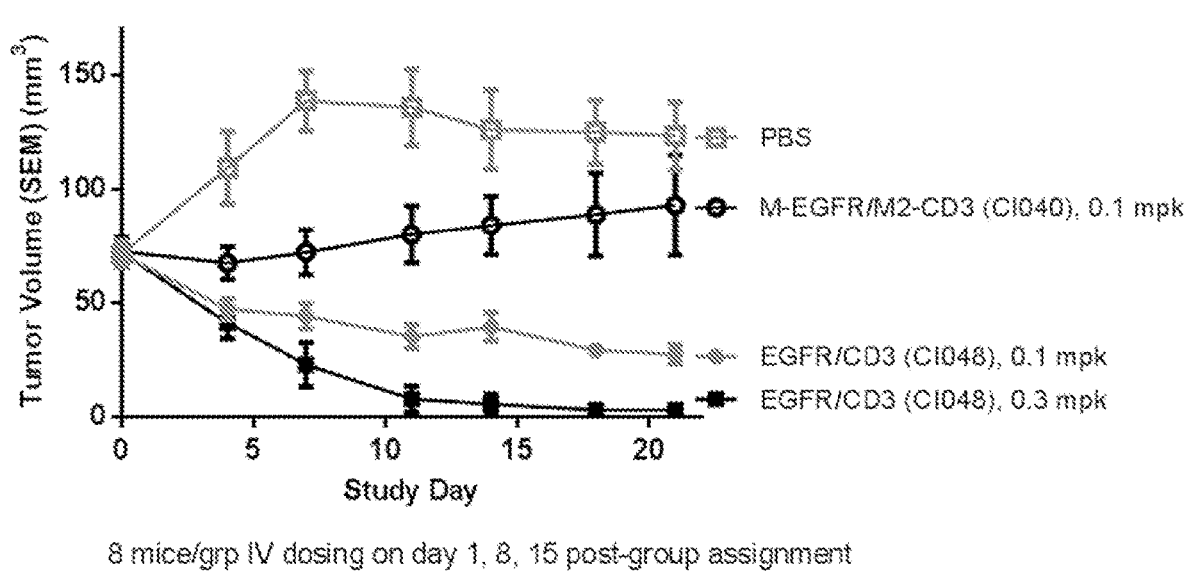
FIG. 26 is a graph depicting that the CI048 bispecific antibody at 0.3 mg/kg eliminated HT-29Luc2 xenograft tumors and the CI040 bispecific activatable antibody at 0.1 mg/kg limited the growth of HT-29Luc2 xenograft tumors.

FIG. 26, which plots tumor volume versus days post initial treatment dose, demonstrated that CI048 multispecific antibody at 0.3 mg/kg eliminated HT-29Luc2 xenograft tumors and the CI040 multispecific activatable antibody at 0.1 mg/kg is less efficacious than CI048 but limited the growth of HT-29Luc2 xenograft tumors relative to a PBS control.

Two additional efficacy studies were set up using unassigned animals from the same pool of HT-29Luc2 tumor-bearing, human T cell engrafted NSG mice. The first study was initiated 18 days post tumor implantation with an average starting tumor volume of 107 mm³. This study compared the activities of CI048 multispecific antibody and CI040 multispecific activatable antibody. The mice were grouped and dosed as set forth in Table 16, Groups 1-4. The second study was initiated 26 days post tumor implantation with an average starting tumor volume of 190 mm³. This study evaluated the efficacy of CI011 multispecific activatable antibody. The mice were grouped and dosed IV as set forth in Table 16, Groups 5 and 6.

TABLE 16

Groups and doses for additional dose dependent HT-29Luc2 xenograft add-on studies.

| Group | Count | Tumor[1] | Effector cells[2,3] | Route of Administration Effector cells | Route of Administration compound | Treatment | Dose (mg/kg) | Schedule |
|---|---|---|---|---|---|---|---|---|
| 1 | 7 | HT-29Luc2 | 10.2 million/mouse | IP | IV | PBS | — | d1, d8, d15, d22 |
| 2 | 7 | HT-29Luc2 | 10.2 million/mouse | | | CI048 | 0.30 | |
| 3 | 7 | HT-29Luc2 | 10.2 million/mouse | | | CI040 | 0.30 | |
| 4 | 7 | HT-29Luc2 | 10.2 million/mouse | | | CI040 | 1.0 | |
| 6 | 4 | HT-29Luc2 | 10.2 million/mouse | | | PBS | — | d1, d8 |
| 7 | 4 | HT-29Luc2 | 10.2 million/mouse | | | CI011 | 1.0 | |

[1] 2 million HT-29Luc2 cells were implanted.
[2] PBMC number were normalized to CD3+ number and with a ratio of 1:2 tumor:CD3+ T cell.
[3] frozen PBMCs were allowed to engraft without pre-stimulation for ~19-21 days.

Figure 27:
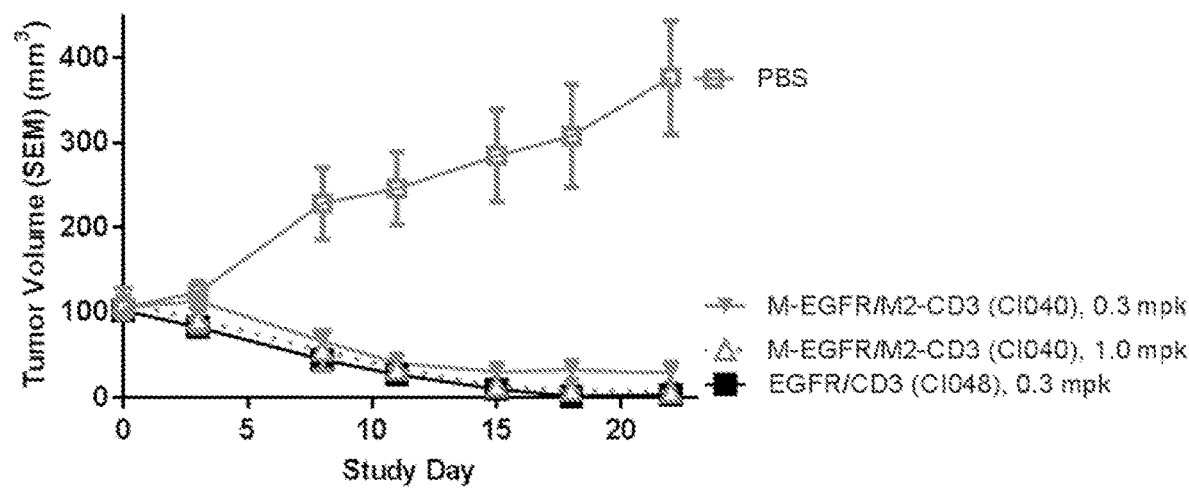
FIG. 27 is a graph depicting that the CI040 bispecific activatable antibody at 1.0 mg/kg and the CI048 bispecific antibody at 0.3 mg/kg eliminated HT-29Luc2 xenograft tumors.

FIG. 27, which plots tumor volume versus days post initial treatment dose, demonstrated that the CI040 multispecific activatable antibody at 1.0 mg/kg and the CI048 multispecific antibody at 0.3 mg/kg produced complete tumor regression in 100% of treated mice. Tumor regression was seen in a majority of mice dosed with 0.3 mg/kg CI040.

Figure 28:
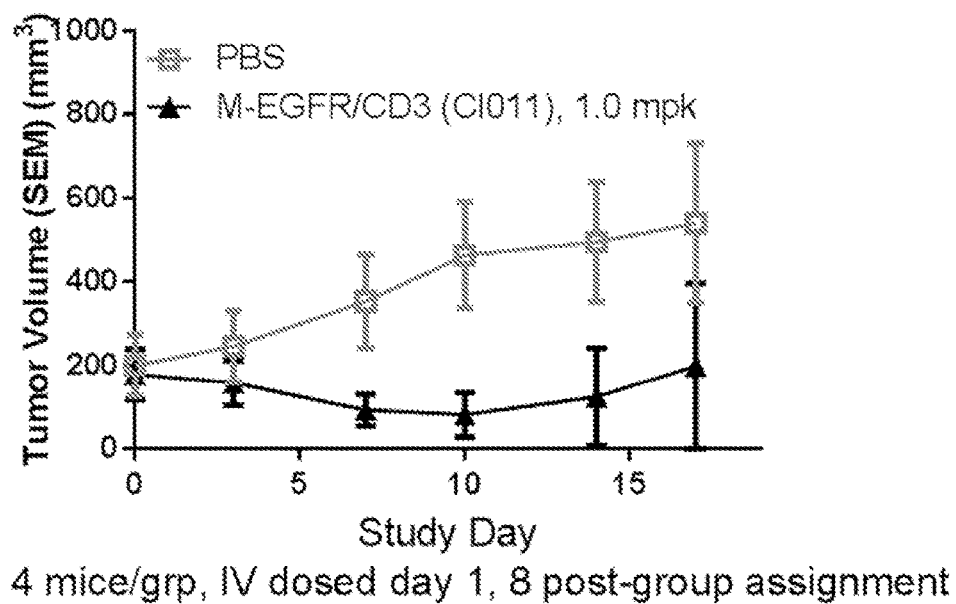
FIG. 28 is a graph depicting that the CI011 bispecific activatable antibody at 1.0 mg/kg significantly inhibited the HT-29Luc2 xenograft tumor growth (p<0.05).

FIG. 28, which plots tumor volume versus days post initial treatment dose, demonstrated CI011 multispecific activatable antibody at 1.0 mg/kg significantly inhibited HT-29Luc2 xenograft tumor growth relative to a vehicle control ($p<0.05$).

Example 17. Maximum Tolerated Dose (MTD) Determination for a Multispecific Antibody and Multispecific Activatable Antibodies in Cynomolgus Monkeys In this example, an escalating dose study design was used to establish the maximum tolerated dose of CI048 EGFRxCD3ε multispecific antibody and CI011 and CI040, two multispecific activatable antibodies following a single IV bolus administration to naïve male cynomolgus monkeys. The monkeys were of Cambodian origin and ranged in weight from 2.5 to 4 kg. CI011 and CI040 varied only in the amino acid sequence of the protease-cleavable site. CI048, CI011 and CI040 were each administered to one animal per dose level beginning at 0.1 micrograms/kg (μg/kg) for CI048 and at 60 μg/kg for CI011 and CI040. The dose was escalated in 2 to 10-fold increments until a MTD for each article was reached or exceeded. One additional animal was then used to confirm the MTD. Each study animal was dosed once and monitored for a minimum of 7 days. Tolerability was evaluated based on clinical signs, body weight, food consumption and laboratory analyses that included serum chemistry and hematology. Blood was collected for standard serum chemistry and hematology analysis once during acclimation and at 48 h and 7 days post dose.

Abnormal clinical signs including emesis, hunching and reduced food intake were observed with the unmasked CI048 multispecific antibody at doses of 10 μg/kg and above, and with CI011 or CI040 multispecific activatable antibodies at doses ≥200 μg/kg. At the MTDs of 20 μg/kg for CI048, ≥200 μg/kg for CI040 and ≥600 μg/kg for CI011, these findings, when present, were transient and generally confined to the 48 hr post-dose period. Serum chemistry findings at the MTD included mild to moderate elevations of alanine transaminase (ALT, a liver enzyme marker found in serum upon liver cell lysis) at 48 hr that were fully reversed by Day 8. A single animal dosed with CI048 at 60 μg/kg, demonstrated more severe and protracted clinical signs, correlating with substantially elevated ALT, AST, bilirubin and blood urea nitrogen at 48 hr post dose. This animal also had marked increases in serum cytokines including IL-6, IFN-gamma and TNF-alpha at 1 or 4 hr post dose, and a massively expanded lymphocyte population on Day 8. The findings of liver and kidney injury at CI048 doses exceeding the MTD are similar to those noted by Lutterbuese and co-workers in a study with an EGFRxCD3 bispecific molecule (PNAS 2010, vol. 107(28) 12605-12610) and may be attributable to T cell-mediated tissue injury.

Figure 29:
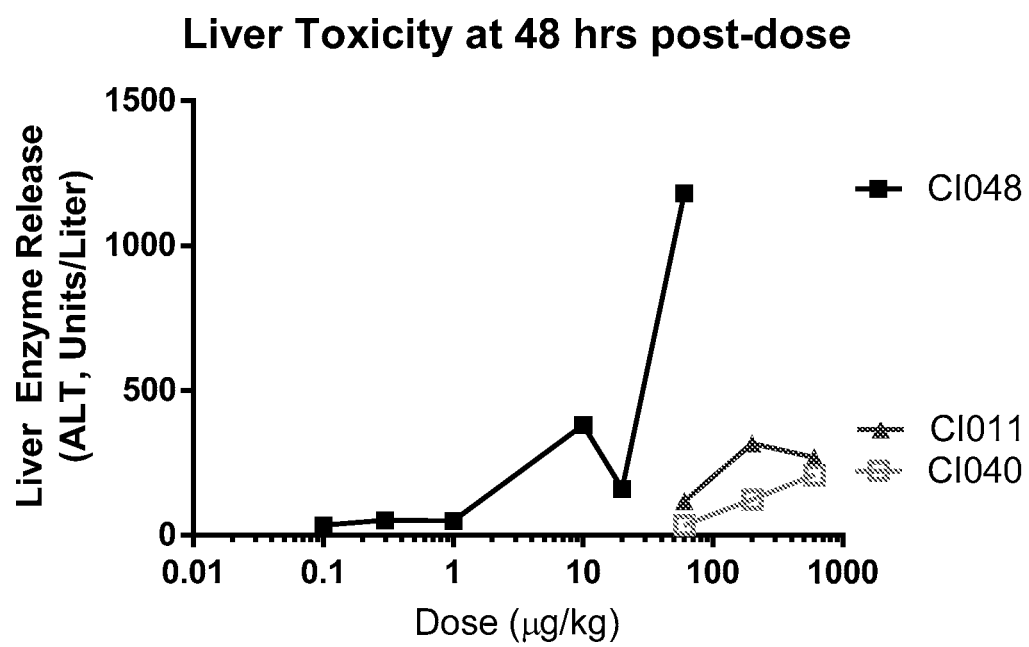
FIG. 29 is a graph depicting dose-response plots for CI048, CI011 and CI048 for serum alanine aminotransferase (ALT) concentration 48 hours post-dose.

FIG. 29 depicts 48 hr post-dose serum concentration of alanine aminotransferase (ALT) as a function of test article dose. A marked increase in ALT was noted at 60 μg/kg CI048 multispecific antibody. Re-dosing of CI048 at 20 μg/kg established the tolerated dose at 20 μg/kg. Administration of CI011 and CI040 multispecific activatable antibodies at doses of 600 μg/kg resulted in serum ALT levels that were comparable to serum ALT concentrations associated with 10-20 μg/kg CI048.

Example 18. Binding of Dually Masked Multispecific Activatable Antibodies to EGFR+ HT-29 Cells and Mouse CD3ε+ TK1 Cells To determine if mouse CD3ε and EGFR masks could attenuate binding in a multispecific activatable antibody, a flow cytometry assay was performed. Mouse CD3ε+ TK1 cells (ATCC, Catalog CRL-2396) were cultured in RPMI-1640+glutamax, 10% Heat Inactivated-Fetal Bovine Serum, 100 U/ml penicillin, and 100 μg/ml streptomycin according to ATCC guidelines. Binding to mouse CD3ε+ TK1 cells and EGFR+HT-29 cells was performed as previously described on the following multispecific antibody and multispecific activatable antibodies: CI052 (EGFR/mCD3), CI053 (M-EGFR/M01-mCD3), CI054 (M-EGFR/M02-mCD3), CI055 (M-EGFR/M03-mCD3), CI056 (M-EGFR/M04-mCD3), CI049 (M-EGFR/M05-mCD3), CI050 (M-EGFR/M06-mCD3), CI051 (M-EGFR/M07-mCD3), CI057 (M-EGFR/M08-mCD3), and CI058 (M-EGFR/M09/mCD3). FIG. 30 demonstrates that incorporation of the mouse CD3ε masks into the EGFR masked multispecific activatable antibody shifted the $EC_{50}$ values for mouse CD3ε binding while retaining effective EGFR masking.

Example 19. Characterization of IL6R Targeting Dually Masked Multispecific Activatable Antibodies To determine if the CD3ε and IL6R masks of a multispecific activatable antibody could attenuate cell killing, a cytotoxicity assay was performed. Cell killing was evaluated by co-culturing purified human CD8+ cells and IL6R+ Molp-8 cells in a 6 to 1 ratio. Human CD8+ T cells were isolated from frozen PBMCs by negative selection using the Dynabeads® Untouched™ Human CD8 T Cells Kit (Life Technologies, Catalog 11348D). Molp-8 cells (DSMZ, Catalog ACC 569) were cultured according to DSMZ guidelines in RPMI-1640+glutamax, 20% Heat Inactivated-Fetal Bovine Serum, 100 U/ml penicillin, and 100 μg/ml streptomycin. Titrations of the following multispecific antibody and multispecific, activatable antibodies were tested: CI026 (IL6R/hCD3), CI027 (IL6R/M-hCD3), CI036 (M-IL6R/hCD3) and CI029 (M-IL6R/M-hCD3). Co-culture conditions and quantification of cytotoxicity is described in the previous example.

Figure 31:
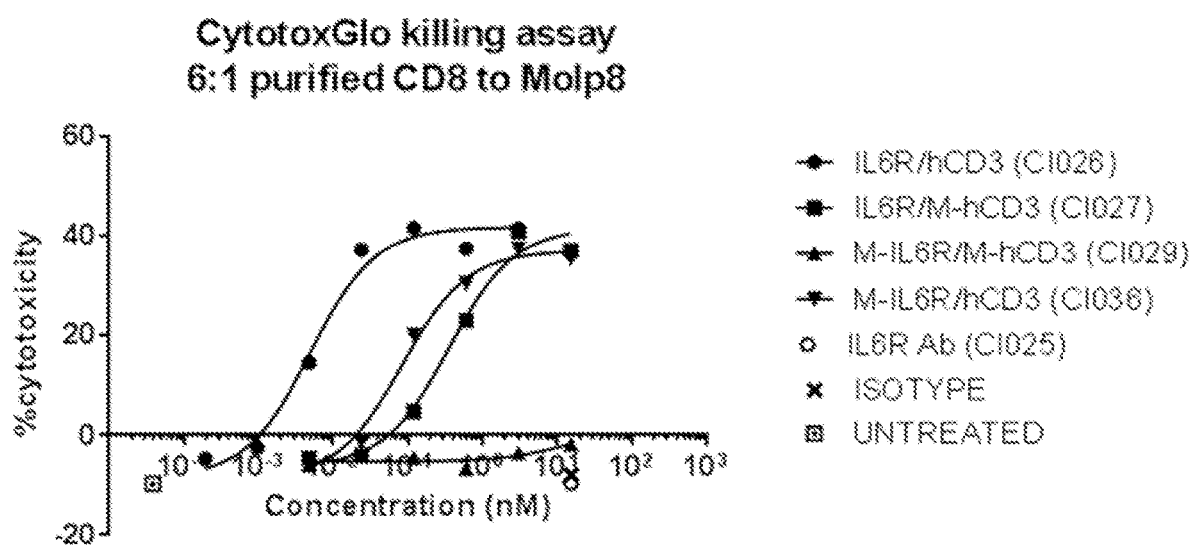
FIG. 31 demonstrate that killing of IL6R+Molp-8 cells is maximally attenuated by masking both IL6R and CD3 binding.

FIG. 31 demonstrates that killing of IL6R+ Molp-8 cells is maximally attenuated by masking both IL6R and CD3 binding in the multispecific, activatable antibody.

OTHER EMBODIMENTS

While the invention has been described in conjunction with the detailed description thereof, the foregoing description is intended to illustrate and not limit the scope of the disclosure, which is defined by the scope of the appended claims. Other aspects, advantages, and modifications are within the scope of the following claims.

SEQUENCE LISTING (927 sequences)

SEQ ID NO: 1 - DNA, 327 bp, Artificial Sequence
  Synthetic polynucleotide
caggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctg

SEQ ID NO: 2 - protein, 109 aa, Artificial Sequence
  Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 3 - DNA, 375 bp, Artificial Sequence
  Synthetic polynucleotide
gaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 4 - protein, 125 aa, Artificial Sequence
  Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 5 - DNA, 747 bp, Artificial Sequence
  Synthetic polynucleotide
caggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 6 - protein, 249 aa, Artificial Sequence
  Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 7 - DNA, 1455 bp, Artificial Sequence
  Synthetic polynucleotide
caggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 8 - protein, 485 aa, Artificial Sequence
  Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9 - DNA, 879 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 10 - protein, 293 aa, Artificial Sequence
  Synthetic polypeptide
QGQSGQGYRWGCEWNCGGITTGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 11 - DNA, 1587 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - protein, 529 aa, Artificial Sequence
  Synthetic polypeptide
QGQSGQGYRWGCEWNCGGITTGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - DNA, 879 bp, Artificial Sequence
  Synthetic polynucleotide
caaggccagtctggccaatggtattcgggtgggtgcgaggctttttgcggtattttgtcgtcgggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 14 - protein, 293 aa, Artificial Sequence
  Synthetic polypeptide
QGQSGQWYSGGCEAFCGILSSGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 15 - DNA, 1587 bp, Artificial Sequence
  Synthetic polynucleotide
caaggccagtctggccaatggtattcgggtgggtgcgaggctttttgcggtattttgtcgtcgggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 16 - protein, 529 aa, Artificial Sequence
  Synthetic polypeptide
QGQSGQWYSGGCEAFCGILSSGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 879 bp, Artificial Sequence
  Synthetic polynucleotide
caaggccagtctggccaagtttattattgcggtgggaatgagagtctgtgcggtgagaggaggggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 18 - protein, 293 aa, Artificial Sequence
  Synthetic polypeptide
QGQSGQVYYCGGNESLCGERRGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 19 - DNA, 1587 bp, Artificial Sequence
  Synthetic polynucleotide
caaggccagtctggccaagtttattattgcggtgggaatgagagtctgtgcggtgagaggaggggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 20 - protein, 529 aa, Artificial Sequence
  Synthetic polypeptide
QGQSGQVYYCGGNESLCGERRGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - DNA, 879 bp, Artificial Sequence
  Synthetic polynucleotide
caaggccagtctggccaatttatgtgccagcagcggatgtgggggaatgagttttgccatcagggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 22 - protein, 293 aa, Artificial Sequence
  Synthetic polypeptide
QGQSGQFMCQQRMWGNEFCHQGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 23 - DNA, 1587 bp, Artificial Sequence
  Synthetic polynucleotide
caaggccagtctggccaatttatgtgccagcagcggatgtgggggaatgagttttgccatcagggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 24 - protein, 529 aa, Artificial Sequence
  Synthetic polypeptide
QGQSGQFMCQQRMWGNEFCHQGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - DNA, 879 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 26 - protein, 293 aa, Artificial Sequence
  Synthetic polypeptide
QGQSGQMMYCGGNEVLCGPRVGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 27 - DNA, 1587 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 28 - protein, 529 aa, Artificial Sequence
  Synthetic polypeptide
QGQSGQMMYCGGNEVLCGPRVGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - DNA, 747 bp, Artificial Sequence
  Synthetic polynucleotide
gaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 30 - protein, 249 aa, Artificial Sequence
  Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 31 - DNA, 1455 bp, Artificial Sequence
  Synthetic polynucleotide
gaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 32 - protein, 485 aa, Artificial Sequence
  Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - DNA, 879 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 34 - protein, 293 aa, Artificial Sequence
  Synthetic polypeptide
QGQSGQGYRWGCEWNCGGITTGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 35 - DNA, 1587 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 36 - protein, 529 aa, Artificial Sequence
  Synthetic polypeptide
QGQSGQGYRWGCEWNCGGITTGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - DNA, 879 bp, Artificial Sequence
  Synthetic polynucleotide
caaggccagtctggccaatggtattcgggtgggtgcgaggctttttgcggtattttgtcgtcgggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 38 - protein, 293 aa, Artificial Sequence
  Synthetic polypeptide
QGQSGQWYSGGCEAFCGILSSGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 39 - DNA, 1587 bp, Artificial Sequence
  Synthetic polynucleotide
caaggccagtctggccaatggtattcgggtgggtgcgaggctttttgcggtattttgtcgtcgggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 40 - protein, 529 aa, Artificial Sequence
  Synthetic polypeptide
QGQSGQWYSGGCEAFCGILSSGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - DNA, 879 bp, Artificial Sequence
  Synthetic polynucleotide
caaggccagtctggccaagtttattattgcggtgggaatgagagtctgtgcggtgagaggaggggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 42 - protein, 293 aa, Artificial Sequence
  Synthetic polypeptide
QGQSGQVYYCGGNESLCGERRGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 43 - DNA, 1587 bp, Artificial Sequence
  Synthetic polynucleotide
caaggccagtctggccaagtttattattgcggtgggaatgagagtctgtgcggtgagaggaggggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 44 - protein, 529 aa, Artificial Sequence
  Synthetic polypeptide
QGQSGQVYYCGGNESLCGERRGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - DNA, 879 bp, Artificial Sequence
  Synthetic polynucleotide
caaggccagtctggccaatttatgtgccagcagcggatgtgggggaatgagttttgccatcagggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 46 - protein, 293 aa, Artificial Sequence
  Synthetic polypeptide
QGQSGQFMCQQRMWGNEFCHQGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 47 - DNA, 1587 bp, Artificial Sequence
  Synthetic polynucleotide
caaggccagtctggccaatttatgtgccagcagcggatgtgggggaatgagttttgccatcagggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 48 - protein, 529 aa, Artificial Sequence
  Synthetic polypeptide
QGQSGQFMCQQRMWGNEFCHQGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - DNA, 879 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 50 - protein, 293 aa, Artificial Sequence
  Synthetic polypeptide
QGQSGQMMYCGGNEVLCGPRVGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 51 - DNA, 1587 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - protein, 529 aa, Artificial Sequence
  Synthetic polypeptide
QGQSGQMMYCGGNEVLCGPRVGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 5 aa, Artificial Sequence
  Synthetic oligopeptide
TYAMN

SEQ ID NO: 54 - protein, 19 aa, Artificial Sequence
  Synthetic oligopeptide
RIRSKYNNYATYYADSVKD

SEQ ID NO: 55 - protein, 14 aa, Artificial Sequence
  Synthetic oligopeptide
HGNFGNSYVSWFAY

SEQ ID NO: 56 - protein, 14 aa, Artificial Sequence
  Synthetic oligopeptide
RSSTGAVTTSNYAN

SEQ ID NO: 57 - protein, 7 aa, Artificial Sequence
  Synthetic oligopeptide
GTNKRAP

SEQ ID NO: 58 - protein, 9 aa, Artificial Sequence
  Synthetic oligopeptide
ALWYSNLWV

SEQ ID NO: 59 - protein, 5 aa, Artificial Sequence
  Synthetic oligopeptide
GSGGS

SEQ ID NO: 60 - protein, 4 aa, Artificial Sequence
  Synthetic oligopeptide
GGGS

SEQ ID NO: 61 - protein, 4 aa, Artificial Sequence
  Synthetic oligopeptide
GGSG

SEQ ID NO: 62 - protein, 5 aa, Artificial Sequence
  Synthetic oligopeptide
GGSGG

SEQ ID NO: 63 - protein, 5 aa, Artificial Sequence
  Synthetic oligopeptide
GSGSG

SEQ ID NO: 64 - protein, 5 aa, Artificial Sequence
  Synthetic oligopeptide
GSGGG

SEQ ID NO: 65 - protein, 5 aa, Artificial Sequence
  Synthetic oligopeptide
GGGSG

SEQ ID NO: 66 - protein, 5 aa, Artificial Sequence
  Synthetic oligopeptide
GSSSG

SEQ ID NO: 67 - protein, 8 aa, Artificial Sequence
  Synthetic oligopeptide
LSGRSDNH

SEQ ID NO: 68 - protein, 8 aa, Artificial Sequence
  Synthetic oligopeptide
TGRGPSWV

SEQ ID NO: 69 - protein, 8 aa, Artificial Sequence
  Synthetic oligopeptide
SARGPSRW

SEQ ID NO: 70 - protein, 8 aa, Artificial Sequence
  Synthetic oligopeptide
TARGPSFK

SEQ ID NO: 71 - protein, 8 aa, Artificial Sequence
  Synthetic oligopeptide
GGWHTGRN

SEQ ID NO: 72 - protein, 8 aa, Artificial Sequence
  Synthetic oligopeptide
HTGRSGAL

SEQ ID NO: 73 - protein, 8 aa, Artificial Sequence
  Synthetic oligopeptide
PLTGRSGG

SEQ ID NO: 74 - protein, 8 aa, Artificial Sequence
  Synthetic oligopeptide
AARGPAIH

SEQ ID NO: 75 - protein, 8 aa, Artificial Sequence
  Synthetic oligopeptide
RGPAFNPM

SEQ ID NO: 76 - protein, 8 aa, Artificial Sequence
  Synthetic oligopeptide
SSRGPAYL

SEQ ID NO: 77 - protein, 8 aa, Artificial Sequence
  Synthetic oligopeptide
RGPATPIM

SEQ ID NO: 78 - protein, 4 aa, Artificial Sequence
  Synthetic oligopeptide
RGPA

SEQ ID NO: 79 - protein, 10 aa, Artificial Sequence
  Synthetic oligopeptide
GGQPSGMWGW

SEQ ID NO: 80 - protein, 10 aa, Artificial Sequence
  Synthetic oligopeptide
FPRPLGITGL

SEQ ID NO: 81 - protein, 10 aa, Artificial Sequence
  Synthetic oligopeptide
VHMPLGFLGP

SEQ ID NO: 82 - protein, 8 aa, Artificial Sequence
  Synthetic oligopeptide
SPLTGRSG

SEQ ID NO: 83 - protein, 8 aa, Artificial Sequence
  Synthetic oligopeptide
SAGFSLPA

SEQ ID NO: 84 - protein, 9 aa, Artificial Sequence
  Synthetic oligopeptide
LAPLGLQRR

SEQ ID NO: 85 - protein, 8 aa, Artificial Sequence
  Synthetic oligopeptide
SGGPLGVR

SEQ ID NO: 86 - protein, 4 aa, Artificial Sequence
  Synthetic oligopeptide
PLGL

SEQ ID NO: 87 - protein, 6 aa, Artificial Sequence
  Synthetic oligopeptide
QGQSGQ

SEQ ID NO: 88 - protein, 5 aa, Artificial Sequence
  Synthetic oligopeptide
SYAMS

SEQ ID NO: 89 - protein, 17 aa, Artificial Sequence
  Synthetic oligopeptide
SIDPEGRQTYYADSVKG

SEQ ID NO: 90 - protein, 10 aa, Artificial Sequence
  Synthetic oligopeptide
DIGGRSAFDY

SEQ ID NO: 91 - protein, 9 aa, Artificial Sequence
  Synthetic oligopeptide
RASQSISSY

SEQ ID NO: 92 - protein, 7 aa, Artificial Sequence
  Synthetic oligopeptide
AASSLQS

SEQ ID NO: 93 - protein, 9 aa, Artificial Sequence
  Synthetic oligopeptide
QQTVVAPPL

SEQ ID NO: 94 - protein, 5 aa, Artificial Sequence
  Synthetic oligopeptide
NYGVH

SEQ ID NO: 95 - protein, 16 aa, Artificial Sequence
  Synthetic oligopeptide
VIWSGGNTDYNTPFTS

SEQ ID NO: 96 - protein, 11 aa, Artificial Sequence
  Synthetic oligopeptide
ALTYYDYEFAY

SEQ ID NO: 97 - protein, 11 aa, Artificial Sequence
  Synthetic oligopeptide
RASQSIGTNIH

SEQ ID NO: 98 - protein, 8 aa, Artificial Sequence
  Synthetic oligopeptide
KYASESIS

SEQ ID NO: 99 - protein, 9 aa, Artificial Sequence
  Synthetic oligopeptide
QQNNNWPTT

SEQ ID NO: 100 - DNA, 1350 bp, Artificial Sequence
  Synthetic polynucleotide
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgaactgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 101 - protein, 449 aa, Artificial Sequence
  Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - DNA, 645 bp, Artificial Sequence
  Synthetic polynucleotide
cagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 103 - protein, 214 aa, Artificial Sequence
  Synthetic polypeptide
QILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - DNA, 1350 bp, Artificial Sequence
  Synthetic polynucleotide
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagcaacgataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgaactgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 105 - protein, 449 aa, Artificial Sequence
  Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - DNA, 1350 bp, Artificial Sequence
  Synthetic polynucleotide
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgaactgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 107 - protein, 449 aa, Artificial Sequence
  Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 449 aa, Artificial Sequence
  Synthetic polypeptide
QVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 214 aa, Artificial Sequence [sequence omitted]

SEQ ID NO: 110 - protein, 214 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTVVAPPLFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 449 aa, Artificial Sequence
  Synthetic polypeptide
EVQLLESGGGLVQPGGSLRLSCAASGFTFSSYAMSWVRQAPGKGLEWVSSIDPEGRQTYYADSVKGRFTISRDNSKNTLYLQMNSLRAEDTAVYYCAKDIGGRSAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 449 aa, Artificial Sequence
  Synthetic polypeptide
EVHLLESGGGLVQPGGSLRLSCAASGFTFSSYAMSWVRQAPGKGLEWVSSIDPEGRQTYYADSVKGRFTISRDNSKNTLYLQMNSLRAEDTAVYYCAKDIGGRSAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 214 aa, Artificial Sequence
  Synthetic polypeptide
  misc_feature (182)..(182): Xaa can be any naturally occurring amino acid
DIQMTQSPSSLSASVGDRVTITCRASQSISSYLNWYQQKPGKAPKLLIYAASSLQSGVPSRFSGSGSGTDFTLTISSLQPEDFATYYCQQTVVAPPLFGQGTKVEIKRTVAAPSVFIFPPSDEQLKSGTASVVCLLNNFYPREAKVQWKVDNALQSGNSQESVTEQDSKDSTYSLSSTLTLXKADYEKHKVYACEVTHQGLSSPVTKSFNRGEC

SEQ ID NO: 114 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSVVAPLTFGQGTKVEIKR

SEQ ID NO: 115 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKDIGGRSAFDYWGQGTLVTVSS

SEQ ID NO: 116 - protein, 108 aa, Artificial Sequence; identical to SEQ ID NO: 114
  Synthetic polypeptide

SEQ ID NO: 117 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKSPPYHGQFDYWGQGTLVTVSS

SEQ ID NO: 118 - protein, 108 aa, Artificial Sequence; identical to SEQ ID NO: 114
  Synthetic polypeptide

SEQ ID NO: 119 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKSPPFFGQFDYWGQGTLVTVSS

SEQ ID NO: 120 - protein, 108 aa, Artificial Sequence; identical to SEQ ID NO: 114
  Synthetic polypeptide

SEQ ID NO: 121 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKHIGRTNPFDYWGQGTLVTVSS

SEQ ID NO: 122 - protein, 108 aa, Artificial Sequence; identical to SEQ ID NO: 114
  Synthetic polypeptide

SEQ ID NO: 123 - protein, 116 aa, Artificial Sequence
  Synthetic polypeptide
EVQLLESGGGLVQPGGSLRLSCAASGFTFSSYAMSWVRQAPGKGLEWVSSIEQMGWQTEYADSVKGRFTISRDNSKNTLYLQMNSLRAEDTAVYYCAKSAAAFDYWGQGTLVTVSS

SEQ ID NO: 124 - protein, 108 aa, Artificial Sequence; identical to SEQ ID NO: 114
  Synthetic polypeptide

SEQ ID NO: 125 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKSPPYYGQFDYWGQGTLVTVSS

SEQ ID NO: 126 - protein, 108 aa, Artificial Sequence; identical to SEQ ID NO: 114
  Synthetic polypeptide

SEQ ID NO: 127 - protein, 119 aa, Artificial Sequence; identical to SEQ ID NO: 119
  Synthetic polypeptide

SEQ ID NO: 128 - protein, 108 aa, Artificial Sequence; identical to SEQ ID NO: 114
  Synthetic polypeptide

SEQ ID NO: 129 - protein, 119 aa, Artificial Sequence; identical to SEQ ID NO: 115
  Synthetic polypeptide

SEQ ID NO: 130 - protein, 108 aa, Artificial Sequence; identical to SEQ ID NO: 114
  Synthetic polypeptide

SEQ ID NO: 131 - protein, 116 aa, Artificial Sequence
  Synthetic polypeptide
EVQLLESGGGLVQPGGSLRLSCAASGFTFSSYAMSWVRQAPGKGLEWVSSIEEMGWQTLYADSVKGRFTISRDNSKNTLYLQMNSLRAEDTAVYYCAKSAAAFDYWGQGTLVTVSS

SEQ ID NO: 132 - protein, 108 aa, Artificial Sequence; identical to SEQ ID NO: 114
  Synthetic polypeptide

SEQ ID NO: 133 - protein, 119 aa, Artificial Sequence; identical to SEQ ID NO: 115
  Synthetic polypeptide

SEQ ID NO: 134 - protein, 108 aa, Artificial Sequence; identical to SEQ ID NO: 114
  Synthetic polypeptide

SEQ ID NO: 135 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKSPPFYGQFDYWGQGTLVTVSS

SEQ ID NO: 136 - protein, 108 aa, Artificial Sequence; identical to SEQ ID NO: 114
  Synthetic polypeptide

SEQ ID NO: 137 - protein, 119 aa, Artificial Sequence; identical to SEQ ID NO: 119
  Synthetic polypeptide

SEQ ID NO: 138 - protein, 108 aa, Artificial Sequence; identical to SEQ ID NO: 114
  Synthetic polypeptide

SEQ ID NO: 139 - protein, 115 aa, Artificial Sequence
  Synthetic polypeptide
EVQLLESGGGLVQPGGSLRLSCAASGFTFSSYAMSWVRQAPGKGLEWVSSIEEMGWQTLYADSVKGRFTISRDNSKNTLYLQMNSLRAEDTAVYYAKSAAAFDYWGQGTLVTVSS

SEQ ID NO: 140 - protein, 108 aa, Artificial Sequence; identical to SEQ ID NO: 114
  Synthetic polypeptide

SEQ ID NO: 141 - protein, 119 aa, Artificial Sequence; identical to SEQ ID NO: 115
  Synthetic polypeptide

SEQ ID NO: 142 - protein, 108 aa, Artificial Sequence; identical to SEQ ID NO: 114
  Synthetic polypeptide

SEQ ID NO: 143 - protein, 116 aa, Artificial Sequence
  Synthetic polypeptide
EVQLLESGGGLVQPGGSLRLSCAASGFTFSSYAMSWVRQAPGKGLEWVSSIDPEGWQTYYADSVKGRFTISRDNSKNTLYLQMNSLRAEDTAVYYCAKSAAAFDYWGQGTLVTVSS

SEQ ID NO: 144 - protein, 108 aa, Artificial Sequence; identical to SEQ ID NO: 114
  Synthetic polypeptide

SEQ ID NO: 145 - protein, 119 aa, Artificial Sequence
  Synthetic polypeptide
EVQLLESGGGLVQPGGSLRLSCAASGFTFSSYAMSWVRQAPGKGLEWVSSIEQMGWQTYYADSVKGRFTISRDNSKNTLYLQMNSLRAEDTAVYYCAKSPPHNGQFDYWGQGTLVTVSS

SEQ ID NO: 146 - protein, 108 aa, Artificial Sequence; identical to SEQ ID NO: 114
  Synthetic polypeptide

SEQ ID NO: 147 - protein, 116 aa, Artificial Sequence; identical to SEQ ID NO: 123
  Synthetic polypeptide

SEQ ID NO: 148 - protein, 108 aa, Artificial Sequence; identical to SEQ ID NO: 114
  Synthetic polypeptide

SEQ ID NO: 149 - protein, 119 aa, Artificial Sequence; identical to SEQ ID NO: 119
  Synthetic polypeptide

SEQ ID NO: 150 - protein, 108 aa, Artificial Sequence; identical to SEQ ID NO: 114
  Synthetic polypeptide

SEQ ID NO: 151 - protein, 116 aa, Artificial Sequence
  Synthetic polypeptide
EVQLLESGGGLVQPGGSLRLSCAASGFTFSSYAMSWVRQAPGKGLEWVSSIDEMGWQTEYADSVKGRFTISRDNSKNTLYLQMNSLRAEDTAVYYCAKSAAAFDYWGQGTLVTVSS

SEQ ID NO: 152 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTLDAPPQFGQGTKVEIKR

SEQ ID NO: 153 - protein, 119 aa, Artificial Sequence; identical to SEQ ID NO: 115
  Synthetic polypeptide

SEQ ID NO: 154 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTVVAPPLFGQGTKVEIKR

SEQ ID NO: 155 - protein, 119 aa, Artificial Sequence
  Synthetic polypeptide
EVQLLESGGGLVQPGGSLRLSCAASGFTFSSYAMSWVRQAPGKGLEWVSSIDPEGRQTYYADSVKGRFTISRDNSKNTLYLQMNSLRAEDTAVYYCAKDIGGRSAFDYWGQGTLVTVSS

SEQ ID NO: 156 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSLVAPLTFGQGTKVEIKR

SEQ ID NO: 157 - protein, 116 aa, Artificial Sequence
  Synthetic polypeptide
EVQLLESGGGLVQPGGSLRLSCAASGFTFSSYAMSWVRQAPGKGLEWVSSIEEMGWQTKYADSVKGRFTISRDNSKNTLYLQMNSLRAEDTAVYYCAKSAAAFDYWGQGTLVTVSS

SEQ ID NO: 158 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQALDAPLMFGQGTKVEIKR

SEQ ID NO: 159 - protein, 119 aa, Artificial Sequence
  Synthetic polypeptide
EVQLLESGGGLVQPGGSLRLSCAASGFTFSSYAMSWVRQAPGKGLEWVSSIEPMGQLTEYADSVKGRFTISRDNSKNTLYLQMNSLRAEDTAVYYCAKDIGGRSAFDYWGQGTLVTVSS

SEQ ID NO: 160 - protein, 108 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQALVAPLTFGQGTKVEIKR

SEQ ID NO: 161 - protein, 116 aa, Artificial Sequence
  Synthetic polypeptide
EVQLLESGGGLVQPGGSLRLSCAASGFTFSSYAMSWVRQAPGKGLEWVSSIDEMGWQTYYADSVKGRFTISRDNSKNTLYLQMNSLRAEDTAVYYCAKSAAAFDYWGQGTLVTVSS

SEQ ID NO: 162 - protein, 108 aa, Artificial Sequence; identical to SEQ ID NO: 160
  Synthetic polypeptide

SEQ ID NO: 163 - protein, 116 aa, Artificial Sequence; identical to SEQ ID NO: 161
  Synthetic polypeptide

SEQ ID NO: 164 - protein, 6 aa, Artificial Sequence
  Synthetic oligopeptide
CISPRG

SEQ ID NO: 165 - protein, 7 aa, Artificial Sequence
  Synthetic oligopeptide
CISPRGC

SEQ ID NO: 166 - protein, 8 aa, Artificial Sequence
  Synthetic oligopeptide
CISPRGCG

SEQ ID NO: 167 - protein, 15 aa, Artificial Sequence
  Synthetic oligopeptide
CISPRGCPDGPYVMY

SEQ ID NO: 168 - protein, 14 aa, Artificial Sequence
  Synthetic oligopeptide
CISPRGCPDGPYVM

SEQ ID NO: 169 - protein, 15 aa, Artificial Sequence
  Synthetic oligopeptide
CISPRGCEPGTYVPT

SEQ ID NO: 170 - protein, 15 aa, Artificial Sequence
  Synthetic oligopeptide
CISPRGCPGQIWHPP

SEQ ID NO: 171 - protein, 15 aa, Artificial Sequence
  Synthetic oligopeptide
GSHCLIPINMGAPSC

SEQ ID NO: 172 - protein, 32 aa, Artificial Sequence
  Synthetic polypeptide
CISPRGCGGSSASQSGQGSHCLIPINMGAPSC

SEQ ID NO: 173 - protein, 19 aa, Artificial Sequence
  Synthetic oligopeptide
CNHHYFYTCGCISPRGCPG

SEQ ID NO: 174 - protein, 19 aa, Artificial Sequence
  Synthetic oligopeptide
ADHVFWGSYGCISPRGCPG

SEQ ID NO: 175 - protein, 19 aa, Artificial Sequence
  Synthetic oligopeptide
CHHVYWGHCGCISPRGCPG

SEQ ID NO: 176 - protein, 19 aa, Artificial Sequence
  Synthetic oligopeptide
CPHFTTTSCGCISPRGCPG

SEQ ID NO: 177 - protein, 19 aa, Artificial Sequence
  Synthetic oligopeptide
CNHHYHYYCGCISPRGCPG

SEQ ID NO: 178 - protein, 19 aa, Artificial Sequence
  Synthetic oligopeptide
CPHVSFGSCGCISPRGCPG

SEQ ID NO: 179 - protein, 19 aa, Artificial Sequence
  Synthetic oligopeptide
CPYYTLSYCGCISPRGCPG

SEQ ID NO: 180 - protein, 19 aa, Artificial Sequence
  Synthetic oligopeptide
CNHVYFGTCGCISPRGCPG

SEQ ID NO: 181 - protein, 19 aa, Artificial Sequence
  Synthetic oligopeptide
CNHFTLTTCGCISPRGCPG

SEQ ID NO: 182 - protein, 19 aa, Artificial Sequence
  Synthetic oligopeptide
CHHFTLTTCGCISPRGCPG

SEQ ID NO: 183 - protein, 18 aa, Artificial Sequence
  Synthetic oligopeptide
YNPCATPMCCISPRGCPG

SEQ ID NO: 184 - protein, 18 aa, Artificial Sequence
  Synthetic oligopeptide
CNHHYFYTCGCISPRGCG

SEQ ID NO: 185 - protein, 18 aa, Artificial Sequence
  Synthetic oligopeptide
CNHHYHYYCGCISPRGCG

SEQ ID NO: 186 - protein, 18 aa, Artificial Sequence
  Synthetic oligopeptide
CNHVYFGTCGCISPRGCG

SEQ ID NO: 187 - protein, 18 aa, Artificial Sequence
  Synthetic oligopeptide
CHHVYWGHCGCISPRGCG

SEQ ID NO: 188 - protein, 18 aa, Artificial Sequence
  Synthetic oligopeptide
CPHFTTTSCGCISPRGCG

SEQ ID NO: 189 - protein, 18 aa, Artificial Sequence
  Synthetic oligopeptide
CNHFTLTTCGCISPRGCG

SEQ ID NO: 190 - protein, 18 aa, Artificial Sequence
  Synthetic oligopeptide
CHHFTLTTCGCISPRGCG

SEQ ID NO: 191 - protein, 18 aa, Artificial Sequence
  Synthetic oligopeptide
CPYYTLSYCGCISPRGCG

SEQ ID NO: 192 - protein, 18 aa, Artificial Sequence
  Synthetic oligopeptide
CPHVSFGSCGCISPRGCG

SEQ ID NO: 193 - protein, 18 aa, Artificial Sequence
  Synthetic oligopeptide
ADHVFWGSYGCISPRGCG

SEQ ID NO: 194 - protein, 17 aa, Artificial Sequence
  Synthetic oligopeptide
YNPCATPMCCISPRGCG

SEQ ID NO: 195 - protein, 18 aa, Artificial Sequence
  Synthetic oligopeptide
CHHVYWGHCGCISPRGCG

SEQ ID NO: 196 - protein, 18 aa, Artificial Sequence
  Synthetic oligopeptide
  VARIANT (2)..(2): X is Asn or Pro
  VARIANT (4)..(4): X is His, Val, or Phe
  VARIANT (5)..(5): X is Tyr or Thr
  VARIANT (6)..(6): X is Phe, Trp, Thr, or Leu
  VARIANT (7)..(7): X is Tyr, Gly, Thr, or Ser
  VARIANT (8)..(8): X is Thr, Ser, Tyr, or His
CXHXXXXXCGCISPRGCG

SEQ ID NO: 197 - protein, 15 aa, Artificial Sequence
  Synthetic oligopeptide
CISPRGCGQPIPSVK

SEQ ID NO: 198 - protein, 15 aa, Artificial Sequence
  Synthetic oligopeptide
CISPRGCTQPYHVSR

SEQ ID NO: 199 - protein, 15 aa, Artificial Sequence
  Synthetic oligopeptide
CISPRGCNAVSGLGS

SEQ ID NO: 200 - protein, 21 aa, Artificial Sequence
  Synthetic polypeptide
QGQSGQCNIWLVGGDCRGWQG

SEQ ID NO: 201 - protein, 26 aa, Artificial Sequence
  Synthetic polypeptide
QGQSGQGQQQWCNIWINGGDCRGWNG

SEQ ID NO: 202 - protein, 15 aa, Artificial Sequence
  Synthetic oligopeptide
PWCMQRQDFLRCPQP

SEQ ID NO: 203 - protein, 15 aa, Artificial Sequence
  Synthetic oligopeptide
QLGLPAYMCTFECLR

SEQ ID NO: 204 - protein, 15 aa, Artificial Sequence
  Synthetic oligopeptide
CNLWVSGGDCGGLQG

SEQ ID NO: 205 - protein, 15 aa, Artificial Sequence
  Synthetic oligopeptide
SCSLWTSGSCLPHSP

SEQ ID NO: 206 - protein, 15 aa, Artificial Sequence
  Synthetic oligopeptide
YCLQLPHYMQAMCGR

SEQ ID NO: 207 - protein, 15 aa, Artificial Sequence
  Synthetic oligopeptide
CFLYSCTDVSYWNNT

SEQ ID NO: 208 - protein, 15 aa, Artificial Sequence
  Synthetic oligopeptide
PWCMQRQDYLRCPQP

SEQ ID NO: 209 - protein, 15 aa, Artificial Sequence
  Synthetic oligopeptide
CNLWISGGDCRGLAG

SEQ ID NO: 210 - protein, 15 aa, Artificial Sequence
  Synthetic oligopeptide
CNLWVSGGDCRGVQG

SEQ ID NO: 211 - protein, 15 aa, Artificial Sequence
  Synthetic oligopeptide
CNLWVSGGDCRGLRG

SEQ ID NO: 212 - protein, 15 aa, Artificial Sequence
  Synthetic oligopeptide
CNLWISGGDCRGLPG

SEQ ID NO: 213 - protein, 15 aa, Artificial Sequence
  Synthetic oligopeptide
CNLWVSGGDCRDAPW

SEQ ID NO: 214 - protein, 15 aa, Artificial Sequence
  Synthetic oligopeptide
CNLWVSGGDCRDLLG

SEQ ID NO: 215 - protein, 15 aa, Artificial Sequence
  Synthetic oligopeptide
CNLWVSGGDCRGLQG

SEQ ID NO: 216 - protein, 15 aa, Artificial Sequence
  Synthetic oligopeptide
CNLWLHGGDCRGWQG

SEQ ID NO: 217 - protein, 15 aa, Artificial Sequence
  Synthetic oligopeptide
CNIWLVGGDCRGWQG

SEQ ID NO: 218 - protein, 15 aa, Artificial Sequence
  Synthetic oligopeptide
CTTWFCGGDCGVMRG

SEQ ID NO: 219 - protein, 15 aa, Artificial Sequence
  Synthetic oligopeptide
CNIWGPSVDCGALLG

SEQ ID NO: 220 - protein, 15 aa, Artificial Sequence
  Synthetic oligopeptide
CNIWVNGGDCRSFEG

SEQ ID NO: 221 - protein, 15 aa, Artificial Sequence
  Synthetic oligopeptide
YCLNLPRYMQDMCWA

SEQ ID NO: 222 - protein, 15 aa, Artificial Sequence
  Synthetic oligopeptide
YCLALPHYMQADCAR

SEQ ID NO: 223 - protein, 15 aa, Artificial Sequence
  Synthetic oligopeptide
CFLYSCGDVSYWGSA

SEQ ID NO: 224 - protein, 15 aa, Artificial Sequence
  Synthetic oligopeptide
CYLYSCTDSAFWNNR

SEQ ID NO: 225 - protein, 15 aa, Artificial Sequence
  Synthetic oligopeptide
CYLYSCNDVSYWSNT

SEQ ID NO: 226 - protein, 12 aa, Artificial Sequence
  Synthetic oligopeptide
CFLYSCTDVSYW

SEQ ID NO: 227 - protein, 15 aa, Artificial Sequence
  Synthetic oligopeptide
CFLYSCTDVAYWNSA

SEQ ID NO: 228 - protein, 15 aa, Artificial Sequence
  Synthetic oligopeptide
CFLYSCTDVSYWGDT

SEQ ID NO: 229 - protein, 15 aa, Artificial Sequence
  Synthetic oligopeptide
CFLYSCTDVSYWGNS

SEQ ID NO: 230 - protein, 15 aa, Artificial Sequence
  Synthetic oligopeptide
CFLYSCTDVAYWNNT

SEQ ID NO: 231 - protein, 18 aa, Artificial Sequence
  Synthetic oligopeptide
CFLYSCGDVSYWGNPGLS

SEQ ID NO: 232 - protein, 15 aa, Artificial Sequence
  Synthetic oligopeptide
CFLYSCTDVAYWSGL

SEQ ID NO: 233 - protein, 15 aa, Artificial Sequence
  Synthetic oligopeptide
CYLYSCTDGSYWNST

SEQ ID NO: 234 - protein, 15 aa, Artificial Sequence
  Synthetic oligopeptide
CFLYSCSDVSYWGNI

SEQ ID NO: 235 - protein, 12 aa, Artificial Sequence
  Synthetic oligopeptide
CFLYSCTDVAYW

SEQ ID NO: 236 - protein, 15 aa, Artificial Sequence
  Synthetic oligopeptide
CFLYSCTDVSYWGST

SEQ ID NO: 237 - protein, 15 aa, Artificial Sequence
  Synthetic oligopeptide
CFLYSCTDVAYWGDT

SEQ ID NO: 238 - protein, 20 aa, Artificial Sequence
  Synthetic oligopeptide
GCNIWLNGGDCRGWVDPLQG

SEQ ID NO: 239 - protein, 20 aa, Artificial Sequence
  Synthetic oligopeptide
GCNIWLVGGDCRGWIGDTNG

SEQ ID NO: 240 - protein, 20 aa, Artificial Sequence
  Synthetic oligopeptide
GCNIWLVGGDCRGWIEDSNG

SEQ ID NO: 241 - protein, 20 aa, Artificial Sequence
  Synthetic oligopeptide
GCNIWANGGDCRGWIDNIDG

SEQ ID NO: 242 - protein, 20 aa, Artificial Sequence
  Synthetic oligopeptide
GCNIWLVGGDCRGWLGEAVG

SEQ ID NO: 243 - protein, 20 aa, Artificial Sequence
  Synthetic oligopeptide
GCNIWLVGGDCRGWLEEAVG

SEQ ID NO: 244 - protein, 20 aa, Artificial Sequence
  Synthetic oligopeptide
GGPALCNIWLNGGDCRGWSG

SEQ ID NO: 245 - protein, 20 aa, Artificial Sequence
  Synthetic oligopeptide
GAPVFCNIWLNGGDCRGWMG

SEQ ID NO: 246 - protein, 20 aa, Artificial Sequence
  Synthetic oligopeptide
GQQQWCNIWINGGDCRGWNG

SEQ ID NO: 247 - protein, 20 aa, Artificial Sequence
  Synthetic oligopeptide
GKSEFCNIWLNGGDCRGWIG

SEQ ID NO: 248 - protein, 20 aa, Artificial Sequence
  Synthetic oligopeptide
GTPGGCNIWANGGDCRGWEG

SEQ ID NO: 249 - protein, 20 aa, Artificial Sequence
  Synthetic oligopeptide
GASQYCNLWINGGDCRGWRG

SEQ ID NO: 250 - protein, 18 aa, Artificial Sequence
  Synthetic oligopeptide
GCNIWLVGGDCRPWVEGG

SEQ ID NO: 251 - protein, 18 aa, Artificial Sequence
  Synthetic oligopeptide
GCNIWAVGGDCRPFVDGG

SEQ ID NO: 252 - protein, 18 aa, Artificial Sequence
  Synthetic oligopeptide
GCNIWLNGGDCRAWVDTG

SEQ ID NO: 253 - protein, 18 aa, Artificial Sequence
  Synthetic oligopeptide
GCNIWIVGGDCRPFINDG

SEQ ID NO: 254 - protein, 18 aa, Artificial Sequence
  Synthetic oligopeptide
GCNIWLNGGDCRPVVFGG

SEQ ID NO: 255 - protein, 18 aa, Artificial Sequence
  Synthetic oligopeptide
GCNIWLSGGDCRMFMNEG

SEQ ID NO: 256 - protein, 18 aa, Artificial Sequence
  Synthetic oligopeptide
GCNIWVNGGDCRSFVYSG

SEQ ID NO: 257 - protein, 18 aa, Artificial Sequence
  Synthetic oligopeptide
GCNIWLNGGDCRGWEASG

SEQ ID NO: 258 - protein, 18 aa, Artificial Sequence
  Synthetic oligopeptide
GCNIWAHGGDCRGFIEPG

SEQ ID NO: 259 - protein, 18 aa, Artificial Sequence
  Synthetic oligopeptide
GCNIWLNGGDCRTFVASG

SEQ ID NO: 260 - protein, 18 aa, Artificial Sequence
  Synthetic oligopeptide
GCNIWAHGGDCRGFIEPG

SEQ ID NO: 261 - protein, 18 aa, Artificial Sequence
  Synthetic oligopeptide
GFLENCNIWLNGGDCRTG

SEQ ID NO: 262 - protein, 18 aa, Artificial Sequence
  Synthetic oligopeptide
GIYENCNIWLNGGDCRMG

SEQ ID NO: 263 - protein, 18 aa, Artificial Sequence
  Synthetic oligopeptide
GIPDNCNIWINGGDCRYG

SEQ ID NO: 264 - protein, 21 aa, Artificial Sequence
  Synthetic polypeptide
QGQSGQYGSCSWNYVHIFMDC

SEQ ID NO: 265 - protein, 21 aa, Artificial Sequence
  Synthetic polypeptide
QGQSGQGDFDIPFPAHWVPIT

SEQ ID NO: 266 - protein, 24 aa, Artificial Sequence
  Synthetic polypeptide
QGQSGQMGVPAGCVWNYAHIFMDC

SEQ ID NO: 267 - protein, 15 aa, Artificial Sequence
  Synthetic oligopeptide
YRSCNWNYVSIFLDC

SEQ ID NO: 268 - protein, 16 aa, Artificial Sequence
  Synthetic oligopeptide
PGAFDIPFPAHWVPNT

SEQ ID NO: 269 - protein, 15 aa, Artificial Sequence
  Synthetic oligopeptide
ESSCVWNYVHIYMDC

SEQ ID NO: 270 - protein, 15 aa, Artificial Sequence
  Synthetic oligopeptide
YPGCKWNYDRIFLDC

SEQ ID NO: 271 - protein, 15 aa, Artificial Sequence
  Synthetic oligopeptide
YRTCSWNYVGIFLDC

SEQ ID NO: 272 - protein, 15 aa, Artificial Sequence
  Synthetic oligopeptide
YGSCSWNYVHIFMDC

SEQ ID NO: 273 - protein, 15 aa, Artificial Sequence
  Synthetic oligopeptide
YGSCSWNYVHIFLDC

SEQ ID NO: 274 - protein, 15 aa, Artificial Sequence
  Synthetic oligopeptide
YGSCNWNYVHIFLDC

SEQ ID NO: 275 - protein, 15 aa, Artificial Sequence
  Synthetic oligopeptide
YTSCNWNYVHIFMDC

SEQ ID NO: 276 - protein, 15 aa, Artificial Sequence
  Synthetic oligopeptide
YPGCKWNYDRIFLDC

SEQ ID NO: 277 - protein, 15 aa, Artificial Sequence
  Synthetic oligopeptide
WRSCNWNYAHIFLDC

SEQ ID NO: 278 - protein, 15 aa, Artificial Sequence
  Synthetic oligopeptide
WSNCHWNYVHIFLDC

SEQ ID NO: 279 - protein, 15 aa, Artificial Sequence
  Synthetic oligopeptide
DRSCTWNYVRISYDC

SEQ ID NO: 280 - protein, 15 aa, Artificial Sequence
  Synthetic oligopeptide
SGSCKWDYVHIFLDC

SEQ ID NO: 281 - protein, 15 aa, Artificial Sequence
  Synthetic oligopeptide
SRSCIWNYAHIHLDC

SEQ ID NO: 282 - protein, 15 aa, Artificial Sequence
  Synthetic oligopeptide
SMSCYWQYERIFLDC

SEQ ID NO: 283 - protein, 15 aa, Artificial Sequence
  Synthetic oligopeptide
YRSCNWNYVSIFLDC

SEQ ID NO: 284 - protein, 15 aa, Artificial Sequence
  Synthetic oligopeptide
YGSCSWNYVHIFMDC

SEQ ID NO: 285 - protein, 15 aa, Artificial Sequence
  Synthetic oligopeptide
SGSCKWDYVHIFLDC

SEQ ID NO: 286 - protein, 15 aa, Artificial Sequence
  Synthetic oligopeptide
YKSCHWDYVHIFLDC

SEQ ID NO: 287 - protein, 15 aa, Artificial Sequence
  Synthetic oligopeptide
YGSCTWNYVHIFMEC

SEQ ID NO: 288 - protein, 15 aa, Artificial Sequence
  Synthetic oligopeptide
FSSCNWNYVHIFLDC

SEQ ID NO: 289 - protein, 15 aa, Artificial Sequence
  Synthetic oligopeptide
WRSCNWNYAHIFLDC

SEQ ID NO: 290 - protein, 15 aa, Artificial Sequence
  Synthetic oligopeptide
YGSCQWNYVHIFLDC

SEQ ID NO: 291 - protein, 15 aa, Artificial Sequence
  Synthetic oligopeptide
YRSCNWNYVHIFLDC

SEQ ID NO: 292 - protein, 15 aa, Artificial Sequence
  Synthetic oligopeptide
NMSCHWDYVHIFLDC

SEQ ID NO: 293 - protein, 15 aa, Artificial Sequence
  Synthetic oligopeptide
FGPCTWNYARISWDC

SEQ ID NO: 294 - protein, 15 aa, Artificial Sequence
  Synthetic oligopeptide
  VARIANT (1)..(1): X can be any naturally occuring amino acid
  VARIANT (2)..(2): X can be any naturally occuring amino acid
  VARIANT (5)..(5): X can be any naturally occuring amino acid
  VARIANT (7)..(7): X can be any naturally occuring amino acid
  VARIANT (13)..(13): X can be any naturally occuring amino acid
XXSCXWXYVHIFXDC

SEQ ID NO: 295 - protein, 18 aa, Artificial Sequence
  Synthetic oligopeptide
MGVPAGCVWNYAHIFMDC

SEQ ID NO: 296 - protein, 18 aa, Artificial Sequence
  Synthetic oligopeptide
RDTGGQCRWDYVHIFMDC

SEQ ID NO: 297 - protein, 18 aa, Artificial Sequence
  Synthetic oligopeptide
AGVPAGCTWNYVHIFMEC

SEQ ID NO: 298 - protein, 18 aa, Artificial Sequence
  Synthetic oligopeptide
VGVPNGCVWNYAHIFMEC

SEQ ID NO: 299 - protein, 18 aa, Artificial Sequence
  Synthetic oligopeptide
DGGPAGCSWNYVHIFMEC

SEQ ID NO: 300 - protein, 18 aa, Artificial Sequence
  Synthetic oligopeptide
AVGPAGCWWNYVHIFMEC

SEQ ID NO: 301 - protein, 18 aa, Artificial Sequence
  Synthetic oligopeptide
CTWNYVHIFMDCGEGEGP

SEQ ID NO: 302 - protein, 18 aa, Artificial Sequence
  Synthetic oligopeptide
GGVPEGCTWNYAHIFMEC

SEQ ID NO: 303 - protein, 18 aa, Artificial Sequence
  Synthetic oligopeptide
AEVPAGCWWNYVHIFMEC

SEQ ID NO: 304 - protein, 18 aa, Artificial Sequence
  Synthetic oligopeptide
AGVPAGCTWNYVHIFMEC

SEQ ID NO: 305 - protein, 18 aa, Artificial Sequence
  Synthetic oligopeptide
SGASGGCKWNYVHIFMDC

SEQ ID NO: 306 - protein, 18 aa, Artificial Sequence
  Synthetic oligopeptide
MGVPAGCVWNYAHIFMDC

SEQ ID NO: 307 - protein, 18 aa, Artificial Sequence
  Synthetic oligopeptide
TPGCRWNYVHIFMECEAL

SEQ ID NO: 308 - protein, 18 aa, Artificial Sequence
  Synthetic oligopeptide
VGVPNGCVWNYAHIFMEC

SEQ ID NO: 309 - protein, 16 aa, Artificial Sequence
  Synthetic oligopeptide
PGAFDIPFPAHWVPNT

SEQ ID NO: 310 - protein, 16 aa, Artificial Sequence
  Synthetic oligopeptide
RGACDIPFPAHWIPNT

SEQ ID NO: 311 - protein, 16 aa, Artificial Sequence
  Synthetic oligopeptide
QGDFDIPFPAHWVPIT

SEQ ID NO: 312 - protein, 16 aa, Artificial Sequence
  Synthetic oligopeptide
  VARIANT (1)..(1): X can be any naturally occirung amino acid
XGAFDIPFPAHWVPNT

SEQ ID NO: 313 - protein, 19 aa, Unknown
  Synthetic oligopeptide
RGDGNDSDIPFPAHWVPRT

SEQ ID NO: 314 - protein, 19 aa, Artificial Sequence
  Synthetic oligopeptide
SGVGRDRDIPFPAHWVPRT

SEQ ID NO: 315 - protein, 19 aa, Artificial Sequence
  Synthetic oligopeptide
WAGGNDCDIPFPAHWIPNT

SEQ ID NO: 316 - protein, 19 aa, Artificial Sequence
  Synthetic oligopeptide
WGDGMDVDIPFPAHWVPVT

SEQ ID NO: 317 - protein, 19 aa, Artificial Sequence
  Synthetic oligopeptide
AGSGNDSDIPFPAHWVPRT

SEQ ID NO: 318 - protein, 19 aa, Artificial Sequence
  Synthetic oligopeptide
ESRSGYADIPFPAHWVPRT

SEQ ID NO: 319 - protein, 19 aa, Artificial Sequence
  Synthetic oligopeptide
RECGRCGDIPFPAHWVPRT

SEQ ID NO: 320 - skipped

SEQ ID NO: 321 - protein, 8 aa, Artificial Sequence
  Synthetic oligopeptide
ISSGLLSS

SEQ ID NO: 322 - protein, 8 aa, Artificial Sequence
  Synthetic oligopeptide
QNQALRMA

SEQ ID NO: 323 - protein, 8 aa, Artificial Sequence
  Synthetic oligopeptide
AQNLLGMV

SEQ ID NO: 324 - protein, 8 aa, Artificial Sequence
  Synthetic oligopeptide
STFPFGMF

SEQ ID NO: 325 - protein, 8 aa, Artificial Sequence
  Synthetic oligopeptide
PVGYTSSL

SEQ ID NO: 326 - protein, 8 aa, Artificial Sequence
  Synthetic oligopeptide
DWLYWPGI

SEQ ID NO: 327 - protein, 8 aa, Artificial Sequence
  Synthetic oligopeptide
MIAPVAYR

SEQ ID NO: 328 - protein, 8 aa, Artificial Sequence
  Synthetic oligopeptide
RPSPMWAY

SEQ ID NO: 329 - protein, 8 aa, Artificial Sequence
  Synthetic oligopeptide
WATPRPMR

SEQ ID NO: 330 - protein, 8 aa, Artificial Sequence
  Synthetic oligopeptide
FRLLDWQW

SEQ ID NO: 331 - protein, 8 aa, Artificial Sequence
  Synthetic oligopeptide
LKAAPRWA

SEQ ID NO: 332 - protein, 8 aa, Artificial Sequence
  Synthetic oligopeptide
GPSHLVLT

SEQ ID NO: 333 - protein, 8 aa, Artificial Sequence
  Synthetic oligopeptide
LPGGLSPW

SEQ ID NO: 334 - protein, 8 aa, Artificial Sequence
  Synthetic oligopeptide
MGLFSEAG

SEQ ID NO: 335 - protein, 8 aa, Artificial Sequence
  Synthetic oligopeptide
SPLPLRVP

SEQ ID NO: 336 - protein, 8 aa, Artificial Sequence
  Synthetic oligopeptide
RMHLRSLG

SEQ ID NO: 337 - protein, 8 aa, Artificial Sequence
  Synthetic oligopeptide
LAAPLGLL

SEQ ID NO: 338 - protein, 8 aa, Artificial Sequence
  Synthetic oligopeptide
AVGLLAPP

SEQ ID NO: 339 - protein, 8 aa, Artificial Sequence
  Synthetic oligopeptide
LLAPSHRA

SEQ ID NO: 340 - protein, 8 aa, Artificial Sequence
  Synthetic oligopeptide
PAGLWLDP

SEQ ID NO: 341 - protein, 7 aa, Artificial Sequence
  Synthetic oligopeptide
ISSGLSS

SEQ ID NO: 342 - protein, 8 aa, Unknown
  Pro-urokinase peptide
PRFKIIGG

SEQ ID NO: 343 - protein, 8 aa, Unknown
  Pro-urokinase peptide
PRFRIIGG

SEQ ID NO: 344 - protein, 9 aa, Unknown
  TGFbeta peptide
SSRHRRALD

SEQ ID NO: 345 - protein, 14 aa, Unknown
  Plasminogen peptide
RKSSIIIRMRDVVL

SEQ ID NO: 346 - protein, 15 aa, Unknown
  Staphylokinase peptide
SSSFDKGKYKKGDDA

SEQ ID NO: 347 - protein, 15 aa, Unknown
  Staphylokinase peptide
SSSFDKGKYKRGDDA

SEQ ID NO: 348 - protein, 4 aa, Unknown
  Factor Xa cleavable sequence
IEGR

SEQ ID NO: 349 - protein, 4 aa, Unknown
  Factor Xa cleavable sequence
IDGR

SEQ ID NO: 350 - protein, 7 aa, Unknown
  Factor Xa cleavable sequence
GGSIDGR

SEQ ID NO: 351 - protein, 6 aa, Unknown
  Gelatinase A peptide
PLGLWA

SEQ ID NO: 352 - protein, 8 aa, Bos taurus
GPQGIAGQ

SEQ ID NO: 353 - protein, 8 aa, Bos taurus
GPQGLLGA

SEQ ID NO: 354 - protein, 5 aa, Bos taurus
GIAGQ

SEQ ID NO: 355 - protein, 8 aa, Bos taurus
GPLGIAGI

SEQ ID NO: 356 - protein, 8 aa, Homo sapiens
GPEGLRVG

SEQ ID NO: 357 - protein, 8 aa, Homo sapiens
YGAGLGVV

SEQ ID NO: 358 - protein, 8 aa, Homo sapiens
AGLGVVER

SEQ ID NO: 359 - protein, 8 aa, Homo sapiens
AGLGISST

SEQ ID NO: 360 - protein, 8 aa, Rattus sp.
EPQALAMS

SEQ ID NO: 361 - protein, 8 aa, Rattus sp.
QALAMSAI

SEQ ID NO: 362 - protein, 8 aa, Rattus sp.
AAYHLVSQ

SEQ ID NO: 363 - protein, 8 aa, Rattus sp.
MDAFLESS

SEQ ID NO: 364 - protein, 8 aa, Rattus sp.
ESLPVVAV

SEQ ID NO: 365 - protein, 8 aa, Rattus sp.
SAPAVESE

SEQ ID NO: 366 - protein, 8 aa, Homo sapiens
DVAQFVLT

SEQ ID NO: 367 - protein, 8 aa, Homo sapiens
VAQFVLTE

SEQ ID NO: 368 - protein, 8 aa, Homo sapiens
AQFVLTEG

SEQ ID NO: 369 - protein, 8 aa, Homo sapiens
PVQPIGPQ

SEQ ID NO: 370 - DNA, 87 bp, Artificial Sequence
  Synthetic polynucleotide
caaggccagtctggccaaatgatgtattgcggtgggaatgaggtgttgtgcgggccgcgggttggctcgagcggtggcagcggtggc

SEQ ID NO: 371 - protein, 15 aa, Artificial Sequence
  Synthetic oligopeptide
YSLWGCEWGCDRGLY

SEQ ID NO: 372 - protein, 15 aa, Artificial Sequence
  Synthetic oligopeptide
GYRWGCEWNCGGITT

SEQ ID NO: 373 - protein, 15 aa, Artificial Sequence
  Synthetic oligopeptide
YSACEMFGEVECCFC

SEQ ID NO: 374 - protein, 15 aa, Artificial Sequence
  Synthetic oligopeptide
WYSGGCEAFCGILSS

SEQ ID NO: 375 - protein, 15 aa, Artificial Sequence
  Synthetic oligopeptide
GYSGGCEFRCYQLYS

SEQ ID NO: 376 - protein, 15 aa, Artificial Sequence
  Synthetic oligopeptide
KFCHCGYYCRVCTLK

SEQ ID NO: 377 - protein, 15 aa, Artificial Sequence
  Synthetic oligopeptide
LGCNNLWGNEFCHPV

SEQ ID NO: 378 - protein, 15 aa, Artificial Sequence
  Synthetic oligopeptide
GHPCWGNESYCHTHS

SEQ ID NO: 379 - protein, 15 aa, Artificial Sequence
  Synthetic oligopeptide
GNNKWCNKPCKCWNK

SEQ ID NO: 380 - protein, 15 aa, Artificial Sequence
  Synthetic oligopeptide
VYYCGGNESLCGERR

SEQ ID NO: 381 - protein, 15 aa, Artificial Sequence
  Synthetic oligopeptide
WMTFGCEFSCGTDEW

SEQ ID NO: 382 - protein, 15 aa, Artificial Sequence
  Synthetic oligopeptide
VYHWGCEYDCFFNDM

SEQ ID NO: 383 - protein, 15 aa, Artificial Sequence
  Synthetic oligopeptide
FSGCCRGWYNCCHRG

SEQ ID NO: 384 - protein, 15 aa, Artificial Sequence
  Synthetic oligopeptide
FMCQQRMWGNEFCHQ

SEQ ID NO: 385 - protein, 15 aa, Artificial Sequence
  Synthetic oligopeptide
MMYCGGNEVLCGPRV

SEQ ID NO: 386 - protein, 15 aa, Artificial Sequence
  Synthetic oligopeptide
TYSKCRYTVKCTKHN

SEQ ID NO: 387 - protein, 15 aa, Artificial Sequence
  Synthetic oligopeptide
WYSGGCEAFCGILSS

SEQ ID NO: 388 - protein, 15 aa, Artificial Sequence
  Synthetic oligopeptide
KYHCTRTSACCTKHH

SEQ ID NO: 389 - protein, 15 aa, Artificial Sequence
  Synthetic oligopeptide
NCFDPYMLLTYSCNS

SEQ ID NO: 390 - protein, 15 aa, Artificial Sequence
  Synthetic oligopeptide
GMCGNLWGDESRCWW

SEQ ID NO: 391 - protein, 15 aa, Artificial Sequence
  Synthetic oligopeptide
SCWDPYMMMNYICNI

SEQ ID NO: 392 - DNA, 58 bp, Artificial Sequence
  Synthetic polynucleotide
acttgtcacgaattcggaagtgcagctggtggaatctgggggcggactggtgcagcct

SEQ ID NO: 393 - DNA, 48 bp, Artificial Sequence
  Synthetic polynucleotide
tagactcgagcggccgctcatttacccggagacagggagaggctcttc

SEQ ID NO: 394 - DNA, 77 bp, Artificial Sequence
  Synthetic polynucleotide
tcggcggaggcaccaagctgaccgtgctgggcggctccctggaccctaagtcatctgacaaaactcacacatgccca

SEQ ID NO: 395 - DNA, 77 bp, Artificial Sequence
  Synthetic polynucleotide
tgggcatgtgtgagttttgtcagatgacttagggtccagggagccgcccagcacggtcagcttggtgcctccgccga

SEQ ID NO: 396 - DNA, 50 bp, Artificial Sequence
  Synthetic polynucleotide
tgcacttgtcacgaattcgcaggctgtcgtgacacaggaaagcgccctga

SEQ ID NO: 397 - DNA, 51 bp, Artificial Sequence
  Synthetic polynucleotide
tctagactcgagcggccgctcatttacccggagacagggagaggctcttct

SEQ ID NO: 398 - DNA, 81 bp, Artificial Sequence
  Synthetic polynucleotide
tggggccagggcaccctcgtgacagtgtctgctggcggctccctggaccctaagtcatctgacaaaactcacacatgccca

SEQ ID NO: 399 - DNA, 81 bp, Artificial Sequence
  Synthetic polynucleotide
tgggcatgtgtgagttttgtcagatgacttagggtccagggagccgccagcagacactgtcacgagggtgccctggcccca

SEQ ID NO: 400 - DNA, 91 bp, Artificial Sequence
  Synthetic polynucleotide
agcggtggctctggtggtctgagcggccgttccgataatcatggcggcggttctcaggctgtcgtgacacaggaaagcgccctgaccacca

SEQ ID NO: 401 - DNA, 79 bp, Artificial Sequence
  Synthetic polynucleotide
ctaagtcttgcacttgtcacgaattcgcaaggccagtctggccaagggtaccaaggctcgagcggtggcagcggtggct

SEQ ID NO: 402 - DNA, 64 bp, Artificial Sequence
  Synthetic polynucleotide
tccgggccacccattccagtcccttgccaggggcctggcgcacccaattcatggcgtaggtgtt

SEQ ID NO: 403 - DNA, 87 bp, Artificial Sequence
  Synthetic polynucleotide
caaggccagtctggccaaggttatcggtggggttgcgagtggaattgcggtgggattactactggctcgagcggtggcagcggtggc

SEQ ID NO: 404 - DNA, 87 bp, Artificial Sequence
  Synthetic polynucleotide
caaggccagtctggccaatggtattcgggtgggtgcgaggctttttgcggtattttgtcgtcgggctcgagcggtggcagcggtggc

SEQ ID NO: 405 - DNA, 87 bp, Artificial Sequence
  Synthetic polynucleotide
caaggccagtctggccaagtttattattgcggtgggaatgagagtctgtgcggtgagaggaggggctcgagcggtggcagcggtggc

SEQ ID NO: 406 - DNA, 87 bp, Artificial Sequence
  Synthetic polynucleotide
caaggccagtctggccaatttatgtgccagcagcggatgtgggggaatgagttttgccatcagggctcgagcggtggcagcggtggc

SEQ ID NO: 407 - protein, 6 aa, Artificial Sequence
  Synthetic oligopeptide
QGQSGQ

SEQ ID NO: 408 - protein, 5 aa, Artificial Sequence
  Synthetic oligopeptide
QGQSG

SEQ ID NO: 409 - protein, 4 aa, Artificial Sequence
  Synthetic oligopeptide
QGQS

SEQ ID NO: 410-411 - skipped (2 entries)

SEQ ID NO: 412 - protein, 7 aa, Artificial Sequence
  Synthetic oligopeptide
QGQSGQG

SEQ ID NO: 413 - DNA, 41 bp, Artificial Sequence
  Synthetic polynucleotide
gccttggagaaccctgtgttctttgctgataccagtgtatg

SEQ ID NO: 414 - DNA, 51 bp, Artificial Sequence
  Synthetic polynucleotide
tttaaaatgaacagtctgcaatctcaggacacagccatatattactgtgcc

SEQ ID NO: 415 - DNA, 51 bp, Artificial Sequence
  Synthetic polynucleotide
ggcacagtaatatatggctgtgtcctgagattgcagactgttcattttaaa

SEQ ID NO: 416 - DNA, 33 bp, Artificial Sequence
  Synthetic polynucleotide
cgggaggagcagtaccagagcacgtaccgtgtg

SEQ ID NO: 417 - DNA, 33 bp, Artificial Sequence
  Synthetic polynucleotide
cacacggtacgtgctctggtactgctcctcccg

SEQ ID NO: 418 - DNA, 23 bp, Artificial Sequence
  Synthetic polynucleotide
caccccattgacgtcaatgggag

SEQ ID NO: 419 - DNA, 23 bp, Artificial Sequence
  Synthetic polynucleotide
gaggggcaaacaacagatggctg

SEQ ID NO: 420 - DNA, 31 bp, Artificial Sequence
  Synthetic polynucleotide
tgaaccgtcagatcactagaagctttattgc

SEQ ID NO: 421 - DNA, 24 bp, Artificial Sequence
  Synthetic polynucleotide
tggatgtgcaccaggtgtgacagc

SEQ ID NO: 422 - DNA, 50 bp, Artificial Sequence
  Synthetic polynucleotide
ctggctgtcacacctggtgcacatccagaggtgcagctggtcgagtctgg

SEQ ID NO: 423 - DNA, 53 bp, Artificial Sequence
  Synthetic polynucleotide
agctgcacctgggatccaccacctcctaggacagtcagtttggttcctccacc

SEQ ID NO: 424 - DNA, 28 bp, Artificial Sequence
  Synthetic polynucleotide
acatctagcaccacgcagccatagtagc

SEQ ID NO: 425 - DNA, 37 bp, Artificial Sequence
  Synthetic polynucleotide
gtgaccacggtctgagaaccgccgccatgattatcgg

SEQ ID NO: 426 - DNA, 35 bp, Artificial Sequence
  Synthetic polynucleotide
ggcggcggttctcagaccgtggtcacacaggagcc

SEQ ID NO: 427 - DNA, 59 bp, Artificial Sequence
  Synthetic polynucleotide
ctctgtttcagctgcacctgggatccaccacctcctgaggagacggtgaccagtgtccc

SEQ ID NO: 428 - DNA, 22 bp, Artificial Sequence
  Synthetic polynucleotide
agaaccgccgccatgattatcg

SEQ ID NO: 429 - DNA, 50 bp, Artificial Sequence
  Synthetic polynucleotide
cgttccgataatcatggcggcggttctgaggtgcagctggtcgagtctgg

SEQ ID NO: 430 - DNA, 52 bp, Artificial Sequence
  Synthetic polynucleotide
ctggctgtcacacctggtgcacatccacaaggccagtctggccaaggttatc

SEQ ID NO: 431 - DNA, 51 bp, Artificial Sequence
  Synthetic polynucleotide
ctggctgtcacacctggtgcacatccacaaggccagtctggccaaatgatg

SEQ ID NO: 432 - DNA, 56 bp, Artificial Sequence
  Synthetic polynucleotide
ctcctgctactatggctgcgtggtgctagatgtcagaccgtggtcacacaggagcc

SEQ ID NO: 433 - DNA, 63 bp, Artificial Sequence
  Synthetic polynucleotide
ctcctgctactatggctgcgtggtgctagatgtgacatccagatgactcagtctcctagctcc

SEQ ID NO: 434 - DNA, 23 bp, Artificial Sequence
  Synthetic polynucleotide
gaagacagatggtgcagccaccg

SEQ ID NO: 435 - DNA, 49 bp, Artificial Sequence
  Synthetic polynucleotide
ctggctgtcacacctggtgcacatccacaggtgcagctgcaggagtccg

SEQ ID NO: 436 - DNA, 21 bp, Artificial Sequence
  Synthetic polynucleotide
gctagcaccaagggcccatcg

SEQ ID NO: 437 - DNA, 21 bp, Artificial Sequence
  Synthetic polynucleotide
ggaagaccgatgggcccttgg

SEQ ID NO: 438 - DNA, 47 bp, Artificial Sequence
  Synthetic polynucleotide
gccctctagactcgagcggccgctcatttacccggagacagggagag

SEQ ID NO: 439 - DNA, 58 bp, Artificial Sequence
  Synthetic polynucleotide
gcaggacccatactggccagactggccttgacatctagcaccacgcagccatagtagc

SEQ ID NO: 440 - DNA, 37 bp, Artificial Sequence
  Synthetic polynucleotide
ggaggtggtggatcccaggtgcagctgcaggagtccg

SEQ ID NO: 441 - DNA, 37 bp, Artificial Sequence
  Synthetic polynucleotide
cagctgcacctgggatccaccacctcctgaggagacg

SEQ ID NO: 442 - DNA, 22 bp, Artificial Sequence
  Synthetic polynucleotide
accgatgggcccttggtgctag

SEQ ID NO: 443 - DNA, 22 bp, Artificial Sequence
  Synthetic polynucleotide
gaccacggtctgagaaccgccg

SEQ ID NO: 444 - DNA, 23 bp, Artificial Sequence
  Synthetic polynucleotide
cacctggtgcacatccacaaggc

SEQ ID NO: 445 - DNA, 2112 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 446 - protein, 703 aa, Artificial Sequence
  Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 447 - DNA, 645 bp, Artificial Sequence
  Synthetic polynucleotide
gatatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 448 - protein, 214 aa, Artificial Sequence
  Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 449 - DNA, 786 bp, Artificial Sequence
  Synthetic polynucleotide
caaggccagtctggccagtgcatctcacctcgtggttgtccggacggcccatacgtcatgtacggctcgagcggtggcagcggtggctctggtggatccggtctgagcggccgttccgataatcatggcagtagcggtacccagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 450 - protein, 261 aa, Artificial Sequence
  Synthetic polypeptide
QGQSGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 451 - DNA, 2244 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 452 - protein, 747 aa, Artificial Sequence
  Synthetic polypeptide
QGQSGQMMYCGGNEVLCGPRVGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 453 - DNA, 2244 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 454 - protein, 747 aa, Artificial Sequence
  Synthetic polypeptide
QGQSGQGYRWGCEWNCGGITTGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1350 bp, Artificial Sequence
  Synthetic polynucleotide
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 456 - protein, 449 aa, Artificial Sequence
  Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 457 - DNA, 645 bp, Artificial Sequence
  Synthetic polynucleotide
gatatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 458 - protein, 214 aa, Artificial Sequence
  Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 459 - DNA, 2112 bp, Artificial Sequence
  Synthetic polynucleotide
cagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 460 - protein, 703 aa, Artificial Sequence
  Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - DNA, 2244 bp, Artificial Sequence
  Synthetic polynucleotide
caaggccagtctggccaaggttatcggtggggttgcgagtggaattgcggtgggattactactggctcgagcggtggcagcggtggctctggtggtctgagcggccgttccgataatcatggcggcggttctgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 462 - protein, 747 aa, Artificial Sequence
  Synthetic polypeptide
QGQSGQGYRWGCEWNCGGITTGSSGGSGGSGGLSGRSDNHGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - DNA, 2244 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 464 - protein, 747 aa, Artificial Sequence
  Synthetic polypeptide
QGQSGQMMYCGGNEVLCGPRVGSSGGSGGSGGLSGRSDNHGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 465 - DNA, 1350 bp, Artificial Sequence
  Synthetic polynucleotide
caggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 466 - protein, 449 aa, Artificial Sequence
  Synthetic polypeptide
QVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 467 - DNA, 645 bp, Artificial Sequence
  Synthetic polynucleotide
gacatccagatgactcagtctcctagctccctgtccgcctctgtgggggaccgagtcaccatcacatgcagagccagccaggatatttctagttacctgaactggtatcagcagaagcccggaaaagcacctaagctgctgatctactatacctccaggctgcactctggcgtgcccagtcggttcagtggctcagggagcggaaccgacttcacttttaccatctcaagcctgcagccagaggatattgccacatactattgtcagcagggcaatacactgccctacacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 468 - protein, 214 aa, Artificial Sequence [sequence omitted]

SEQ ID NO: 469 - DNA, 2112 bp, Artificial Sequence
  Synthetic polynucleotide
cagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 470 - protein, 703 aa, Artificial Sequence
  Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 471 - DNA, 2244 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 472 - protein, 747 aa, Artificial Sequence
  Synthetic polypeptide
QGQSGQMMYCGGNEVLCGPRVGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - DNA, 777 bp, Artificial Sequence
  Synthetic polynucleotide
caaggccagtctggccagtatgggtcctgcagttggaactatgtacacatattcatggattgcggctcgagcggtggcagcggtggctctggtggtctgagcggccgttccgataatcatggcggcggttctgacatccagatgactcagtctcctagctccctgtccgcctctgtgggggaccgagtcaccatcacatgcagagccagccaggatatttctagttacctgaactggtatcagcagaagcccggaaaagcacctaagctgctgatctactatacctccaggctgcactctggcgtgcccagtcggttcagtggctcagggagcggaaccgacttcacttttaccatctcaagcctgcagccagaggatattgccacatactattgtcagcagggcaatacactgccctacacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 474 - protein, 258 aa, Artificial Sequence
  Synthetic polypeptide
QGQSGQYGSCSWNYVHIFMDCGSSGGSGGSGGLSGRSDNHGGGSDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 475 - DNA, 2253 bp, Artificial Sequence
  Synthetic polynucleotide
caaggccagtctggccaatggacgtgcggaggtatggtgtatcttgcgggattctgcatggcgggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 476 - protein, 750 aa, Artificial Sequence
  Synthetic polypeptide
QGQSGQWTCGGMVYLAGFCMAGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - DNA, 2244 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtggtggaggctcgggcggtgggagcggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 478 - protein, 747 aa, Artificial Sequence
  Synthetic polypeptide
QGQSGQMMYCGGNEVLCGPRVGSSGGSGGSGGGGGSGGGSGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - DNA, 2259 bp, Artificial Sequence
  Synthetic polynucleotide
caaggccagtctggccaaatgatgtattgcggtgggaatgaggtgttgtgcgggccgcgggttggctcgagcggtggcagcggtggctctggtggtatctcttccggactgctgtccggcagatccgacaatcacggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 480 - protein, 752 aa, Artificial Sequence
  Synthetic polypeptide
QGQSGQMMYCGGNEVLCGPRVGSSGGSGGSGGISSGLLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - DNA, 801 bp, Artificial Sequence
  Synthetic polynucleotide
caaggccagtctggccagtgcatctcacctcgtggttgtccggacggcccatacgtcatgtacggctcgagcggtggcagcggtggctctggtggatccggtattagcagtggtctgttaagcggtcgtagcgataatcatggcagtagcggtacccagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 482 - protein, 266 aa, Artificial Sequence
  Synthetic polypeptide
QGQSGQCISPRGCPDGPYVMYGSSGGSGGSGGSGISSGLLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 483 - DNA, 672 bp, Artificial Sequence
  Synthetic polynucleotide
tccgataatcatggcagtagcggtacccagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 484 - protein, 223 aa, Artificial Sequence
  Synthetic polypeptide
SDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 485 - DNA, 2253 bp, Artificial Sequence
  Synthetic polynucleotide
caaggccagtctggccaaattcatccgatgtgccatcctgagggtgtttgcgttgctctggatggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 486 - protein, 750 aa, Artificial Sequence
  Synthetic polypeptide
QGQSGQIHPMCHPEGVCVALDGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - DNA, 2253 bp, Artificial Sequence
  Synthetic polynucleotide
caaggccagtctggccaagattgctttgtgcctgggtggtatttggcgggtccgtgcgctcagggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 488 - protein, 750 aa, Artificial Sequence
  Synthetic polypeptide
QGQSGQDCFVPGWYLAGPCAQGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - DNA, 2253 bp, Artificial Sequence
  Synthetic polynucleotide
caaggccagtctggccaaggtgtgtgccattctcggttggagtggcttctgggttgccaaggaggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 490 - protein, 750 aa, Artificial Sequence
  Synthetic polypeptide
QGQSGQGVCHSRLEWLLGCQGGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - DNA, 2100 bp, Artificial Sequence
  Synthetic polynucleotide
gaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 492 - protein, 699 aa, Artificial Sequence
  Synthetic polypeptide
EVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - DNA, 2253 bp, Artificial Sequence
  Synthetic polynucleotide
caaggccagtctggccaattgcatcctatgtgccatcctgagggtctgtgcaagtttactcctggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 494 - protein, 750 aa, Artificial Sequence
  Synthetic polypeptide
QGQSGQLHPMCHPEGLCKFTPGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - DNA, 2253 bp, Artificial Sequence
  Synthetic polynucleotide
caaggccagtctggccaaggtgcttgctctgatatggtttattggggttcgtgcagttggttgggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 496 - protein, 750 aa, Artificial Sequence
  Synthetic polypeptide
QGQSGQGACSDMVYWGSCSWLGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - DNA, 2253 bp, Artificial Sequence
  Synthetic polynucleotide
caaggccagtctggccaagattgcattggattggatcattattttcttggaccgtgcagttctggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 498 - protein, 750 aa, Artificial Sequence
  Synthetic polypeptide
QGQSGQDCIGLDHYFLGPCSSGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - DNA, 2253 bp, Artificial Sequence
  Synthetic polynucleotide
caaggccagtctggccaatctatgtgcactgagcagcagtggattgtgaatcattgcattagtggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 500 - protein, 750 aa, Artificial Sequence
  Synthetic polypeptide
QGQSGQSMCTEQQWIVNHCISGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - DNA, 2253 bp, Artificial Sequence
  Synthetic polynucleotide
caaggccagtctggccaagtgggtgagtgcgttccgggtccgcatgggtgctggatggcttatggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 502 - protein, 750 aa, Artificial Sequence
  Synthetic polypeptide
QGQSGQVGECVPGPHGCWMAYGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - DNA, 2253 bp, Artificial Sequence; identical to SEQ ID NO: 475
  Synthetic polynucleotide

SEQ ID NO: 504 - protein, 750 aa, Artificial Sequence; identical to SEQ ID NO: 476
  Synthetic polypeptide

SEQ ID NO: 505 - DNA, 1512 bp, Artificial Sequence
  Synthetic polynucleotide
gacatcttgctgactcagtctccagtcatcctgtctgtgagtccaggagaaagagtcagtttctcctgcagggccagtcagagcattggcacaaacatacactggtatcagcaaagaacaaatggttctccaaggcttctcataaagtatgcttctgagtctatctctgggatcccttccaggtttagtggcagtggatcagggacagattttactcttagcatcaacagtgtggagtctgaagatattgcagattattactgtcaacaaaataataactggccaaccacatttggtgcaggaacaaagctggaactgaaaggtggtggtggttctggcggcggcggctccggtggtggtggttctcaggtgcagctgaagcagtcaggacctggcctagtgcagccctcacagagcctgtccatcacctgcacagtctctggtttctcattaactaactatggagtacactgggttcgccagtctccaggaaagggtctggagtggctgggagtgatatggagtggtggaaacacagactataatacacctttcacatccagactgagcatcaacaaggacaattccaagagccaagttttctttaaaatgaacagtctgcaatctaatgacacagccatatattactgtgccagagccctgacctattatgactacgagttcgcctattggggtcagggaaccctggttaccgtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctacaccatcaccaccatcatcaccactag

SEQ ID NO: 506 - protein, 495 aa, Artificial Sequence
  Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 507 - DNA, 18 bp, Artificial Sequence
  Synthetic oligonucleotide
caaggccagtctggccag

SEQ ID NO: 508 - protein, 255 aa, Artificial Sequence
  Synthetic polypeptide
CISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 509 - DNA, 768 bp, Artificial Sequence
  Synthetic polynucleotide
tgcatctcacctcgtggttgtccggacggcccatacgtcatgtacggctcgagcggtggcagcggtggctctggtggatccggtctgagcggccgttccgataatcatggcagtagcggtacccagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 510 - protein, 741 aa, Artificial Sequence
  Synthetic polypeptide
GYRWGCEWNCGGITTGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - DNA, 2226 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 512 - protein, 741 aa, Artificial Sequence
  Synthetic polypeptide
MMYCGGNEVLCGPRVGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - DNA, 2226 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 514 - protein, 741 aa, Artificial Sequence
  Synthetic polypeptide
MMYCGGNEVLCGPRVGSSGGSGGSGGLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - DNA, 759 bp, Artificial Sequence
  Synthetic polynucleotide
tatgggtcctgcagttggaactatgtacacatattcatggattgcggctcgagcggtggcagcggtggctctggtggtctgagcggccgttccgataatcatggcggcggttctgacatccagatgactcagtctcctagctccctgtccgcctctgtgggggaccgagtcaccatcacatgcagagccagccaggatatttctagttacctgaactggtatcagcagaagcccggaaaagcacctaagctgctgatctactatacctccaggctgcactctggcgtgcccagtcggttcagtggctcagggagcggaaccgacttcacttttaccatctcaagcctgcagccagaggatattgccacatactattgtcagcagggcaatacactgccctacacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 516 - protein, 252 aa, Artificial Sequence
  Synthetic polypeptide
YGSCSWNYVHIFMDCGSSGGSGGSGGLSGRSDNHGGGSDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 517 - DNA, 2241 bp, Artificial Sequence
  Synthetic polynucleotide
atgatgtattgcggtgggaatgaggtgttgtgcgggccgcgggttggctcgagcggtggcagcggtggctctggtggtatctcttccggactgctgtccggcagatccgacaatcacggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 518 - protein, 746 aa, Artificial Sequence
  Synthetic polypeptide
MMYCGGNEVLCGPRVGSSGGSGGSGGISSGLLSGRSDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - DNA, 783 bp, Artificial Sequence
  Synthetic polynucleotide
tgcatctcacctcgtggttgtccggacggcccatacgtcatgtacggctcgagcggtggcagcggtggctctggtggatccggtattagcagtggtctgttaagcggtcgtagcgataatcatggcagtagcggtacccagatcttgctgacccagagcccggtgattctgagcgtgagcccgggcgaacgtgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 520 - protein, 260 aa, Artificial Sequence
  Synthetic polypeptide
CISPRGCPDGPYVMYGSSGGSGGSGGSGISSGLLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - DNA, 21 bp, Artificial Sequence
  Synthetic polynucleotide
caaggccagtctggccaaggt

SEQ ID NO: 522 - DNA, 2226 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 523 - protein, 449 aa, Artificial Sequence; identical to SEQ ID NO: 456
  Synthetic polypeptide

SEQ ID NO: 524 - protein, 741 aa, Artificial Sequence
  Synthetic polypeptide
GYRWGCEWNCGGITTGSSGGSGGSGGLSGRSDNHGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - DNA, 2226 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 526 - protein, 741 aa, Artificial Sequence
  Synthetic polypeptide
MMYCGGNEVLCGPRVGSSGGSGGSGGLSGRSDNHGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - DNA, 759 bp, Artificial Sequence
  Synthetic polynucleotide
tatgggtcctgcagttggaactatgtacacatattcatggattgcggctcgagcggtggcagcggtggctctggtggctcaggtggaggctcgggcggtgggagcggcggttctgacatccagatgactcagtctcctagctccctgtccgcctctgtgggggaccgagtcaccatcacatgcagagccagccaggatatttctagttacctgaactggtatcagcagaagcccggaaaagcacctaagctgctgatctactatacctccaggctgcactctggcgtgcccagtcggttcagtggctcagggagcggaaccgacttcacttttaccatctcaagcctgcagccagaggatattgccacatactattgtcagcagggcaatacactgccctacacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 528 - protein, 252 aa, Artificial Sequence
  Synthetic polypeptide
YGSCSWNYVHIFMDCGSSGGSGGSGGSGGGSGGGSGGSDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 529 - DNA, 2226 bp, Artificial Sequence
  Synthetic polynucleotide
atgatgtattgcggtgggaatgaggtgttgtgcgggccgcgggttggctcgagcggtggcagcggtggctctggtggtggtggaggctcgggcggtgggagcggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgcaggagtccggaccaggactggtccggccctcacagactctgagcctgacatgcactgtgtcaggctacagcatcacctccgatcacgcctggagctgggtcaggcagccacctggacgcggcctggaatggatcggctacatttcttatagtgggatcaccacatacaacccctctctgaagagtcgagtgaccatttccagagacaactctaaaaatacactgtatctgcagatgaatagtctgcgggccgaggatacagctgtgtactattgtgcacggtctctggccagaactaccgctatggactattgggggcagggaagcctggtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 530 - protein, 741 aa, Artificial Sequence
  Synthetic polypeptide
MMYCGGNEVLCGPRVGSSGGSGGSGGGGGSGGGSGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLQESGPGLVRPSQTLSLTCTVSGYSITSDHAWSWVRQPPGRGLEWIGYISYSGITTYNPSLKSRVTISRDNSKNTLYLQMNSLRAEDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - DNA, 2235 bp, Artificial Sequence
  Synthetic polynucleotide
ttgcatcctatgtgccatcctgagggtctgtgcaagtttactcctggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 532 - protein, 744 aa, Artificial Sequence
  Synthetic polypeptide
LHPMCHPEGLCKFTPGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - DNA, 2232 bp, Artificial Sequence
  Synthetic polynucleotide
gcttgctctgatatggtttattggggttcgtgcagttggttgggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 534 - protein, 744 aa, Artificial Sequence
  Synthetic polypeptide
ACSDMVYWGSCSWLGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKV

SEQ ID NO: 535 - DNA, 2235 bp, Artificial Sequence
  Synthetic polynucleotide
gattgcattggattggatcattattttcttggaccgtgcagttctggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 536 - protein, 744 aa, Artificial Sequence
  Synthetic polypeptide
DCIGLDHYFLGPCSSGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - DNA, 2235 bp, Artificial Sequence
  Synthetic polynucleotide
tctatgtgcactgagcagcagtggattgtgaatcattgcattagtggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 538 - protein, 744 aa, Artificial Sequence
  Synthetic polypeptide
SMCTEQQWIVNHCISGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - DNA, 2235 bp, Artificial Sequence
  Synthetic polynucleotide
attcatccgatgtgccatcctgagggtgtttgcgttgctctggatggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 540 - protein, 744 aa, Artificial Sequence
  Synthetic polypeptide
IHPMCHPEGVCVALDGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - DNA, 2235 bp, Artificial Sequence
  Synthetic polynucleotide
gattgctttgtgcctgggtggtatttggcgggtccgtgcgctcagggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 542 - protein, 744 aa, Artificial Sequence
  Synthetic polypeptide
DCFVPGWYLAGPCAQGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - DNA, 2232 bp, Artificial Sequence
  Synthetic polynucleotide
gtgtgccattctcggttggagtggcttctgggttgccaaggaggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 544 - protein, 743 aa, Artificial Sequence
  Synthetic polypeptide
VCHSRLEWLLGCQGGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - DNA, 2235 bp, Artificial Sequence
  Synthetic polynucleotide
gtgggtgagtgcgttccgggtccgcatgggtgctggatggcttatggaggtggctcgagcggtggcagcggtggctctggtggtattagcagtggtctgttaagcggtcgtagcgataatcatggcggcggttctgaagtgcagctggtggaatctgggggcggactggtgcagcctggcaagtctctgaagctgagctgcgaggccagcggcttcacctttagcggctacggcatgcactgggtgcgccaggcacctggcagaggcctggaaagcgtggcctacatcaccagcagcagcatcaacattaagtacgccgacgccgtgaagggccggttcaccgtgtccagagacaacgccaagaacctgctgttcctgcagatgaacatcctgaagtccgaggacaccgccatgtactactgcgccagattcgactgggacaagaactactggggccagggcacaatggtcacagtgtccagcggtggaggtggtagtggtggaggaagtggaggttcaggaggtggaagcggtggtggtggtagtgacatccagatgacccagagccccagcagcctgcctgcctctctgggcgatagagtgaccatcaactgccaggccagccaggacatcagcaactacctgaactggtatcagcagaagcccggcaaggcccccaagctgctgatctactacaccaacaagctggccgacggtgtgcccagcagattcagcggcagcggtagcggcagagacagcagcttcaccatcagctccctggaatccgaggatatcggcagctactactgccagcagtactacaactacccctggaccttcggccctggcaccaagctggaaatcaaaagaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 546 - protein, 744 aa, Artificial Sequence
  Synthetic polypeptide
VGECVPGPHGCWMAYGGGSSGGSGGSGGISSGLLSGRSDNHGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSGGGSGGSGGGSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - DNA, 861 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 548 - protein, 287 aa, Artificial Sequence
  Synthetic polypeptide
GYRWGCEWNCGGITTGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 549 - DNA, 1569 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 550 - protein, 523 aa, Artificial Sequence
  Synthetic polypeptide
GYRWGCEWNCGGITTGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - DNA, 861 bp, Artificial Sequence
  Synthetic polynucleotide
tggtattcgggtgggtgcgaggctttttgcggtattttgtcgtcgggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 552 - protein, 287 aa, Artificial Sequence
  Synthetic polypeptide
WYSGGCEAFCGILSSGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 553 - DNA, 1569 bp, Artificial Sequence
  Synthetic polynucleotide
tggtattcgggtgggtgcgaggctttttgcggtattttgtcgtcgggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 554 - protein, 523 aa, Artificial Sequence
  Synthetic polypeptide
WYSGGCEAFCGILSSGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 555 - DNA, 861 bp, Artificial Sequence
  Synthetic polynucleotide
gtttattattgcggtgggaatgagagtctgtgcggtgagaggaggggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 556 - protein, 287 aa, Artificial Sequence
  Synthetic polypeptide
VYYCGGNESLCGERRGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 557 - DNA, 1569 bp, Artificial Sequence
  Synthetic polynucleotide
gtttattattgcggtgggaatgagagtctgtgcggtgagaggaggggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 558 - protein, 523 aa, Artificial Sequence
  Synthetic polypeptide
VYYCGGNESLCGERRGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - DNA, 861 bp, Artificial Sequence
  Synthetic polynucleotide
tttatgtgccagcagcggatgtgggggaatgagttttgccatcagggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 560 - protein, 287 aa, Artificial Sequence
  Synthetic polypeptide
FMCQQRMWGNEFCHQGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 561 - DNA, 1569 bp, Artificial Sequence
  Synthetic polynucleotide
tttatgtgccagcagcggatgtgggggaatgagttttgccatcagggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 562 - protein, 523 aa, Artificial Sequence
  Synthetic polypeptide
FMCQQRMWGNEFCHQGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - DNA, 861 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 564 - protein, 287 aa, Artificial Sequence
  Synthetic polypeptide
MMYCGGNEVLCGPRVGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 565 - DNA, 1569 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctcaggctgtcgtgacacaggaaagcgccctgaccaccagccctggcgagacagtgaccctgacctgcagatctagcacaggcgccgtgaccacaagcaactacgccaactgggtgcaggaaaagcccgaccacctgttcaccggcctgatcggcggcaccaacaaaagggctccaggcgtgccagccagattcagcggcagcctgattggcgataaggccgccctgacaatcactggcgcccagaccgaggacgaggccatctacttttgcgccctgtggtacagcaacctgtgggtgttcggcggaggcaccaagctgacagtgctgggaggcggaggatctggcggaggcggaagtggcggagggggatctgaagtgcagctggtggaatctggcggcggactggtgcagcctaagggctctctgaagctgagctgtgccgccagcggcttcaccttcaacacctacgccatgaattgggtgcgccaggcccctggcaagggactggaatgggtggcccggatcagaagcaagtacaacaattacgccacctactacgccgacagcgtgaaggaccggttcaccatcagccgggacgacagccagagcatcctgtatctgcagatgaacaacctgaaaaccgaggacaccgccatgtactactgcgtgcggcacggcaacttcggcaacagctatgtgtcttggtttgcctactggggccagggcaccctcgtgacagtgtctgctggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 566 - protein, 523 aa, Artificial Sequence
  Synthetic polypeptide
MMYCGGNEVLCGPRVGSSGGSGGSGGLSGRSDNHGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGGGSGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - DNA, 861 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 568 - protein, 287 aa, Artificial Sequence
  Synthetic polypeptide
GYRWGCEWNCGGITTGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 569 - DNA, 1569 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 570 - protein, 523 aa, Artificial Sequence
  Synthetic polypeptide
GYRWGCEWNCGGITTGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 571 - DNA, 861 bp, Artificial Sequence
  Synthetic polynucleotide
tggtattcgggtgggtgcgaggctttttgcggtattttgtcgtcgggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 572 - protein, 287 aa, Artificial Sequence
  Synthetic polypeptide
WYSGGCEAFCGILSSGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 573 - DNA, 1569 bp, Artificial Sequence
  Synthetic polynucleotide
tggtattcgggtgggtgcgaggctttttgcggtattttgtcgtcgggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 574 - protein, 523 aa, Artificial Sequence
  Synthetic polypeptide
WYSGGCEAFCGILSSGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - DNA, 861 bp, Artificial Sequence
  Synthetic polynucleotide
gtttattattgcggtgggaatgagagtctgtgcggtgagaggaggggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 576 - protein, 287 aa, Artificial Sequence
  Synthetic polypeptide
VYYCGGNESLCGERRGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 577 - DNA, 1569 bp, Artificial Sequence
  Synthetic polynucleotide
gtttattattgcggtgggaatgagagtctgtgcggtgagaggaggggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 578 - protein, 523 aa, Artificial Sequence
  Synthetic polypeptide
VYYCGGNESLCGERRGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - DNA, 861 bp, Artificial Sequence
  Synthetic polynucleotide
tttatgtgccagcagcggatgtgggggaatgagttttgccatcagggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 580 - protein, 287 aa, Artificial Sequence
  Synthetic polypeptide
FMCQQRMWGNEFCHQGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 581 - DNA, 1569 bp, Artificial Sequence
  Synthetic polynucleotide
tttatgtgccagcagcggatgtgggggaatgagttttgccatcagggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 582 - protein, 523 aa, Artificial Sequence
  Synthetic polypeptide
FMCQQRMWGNEFCHQGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - DNA, 861 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctg

SEQ ID NO: 584 - protein, 287 aa, Artificial Sequence
  Synthetic polypeptide
MMYCGGNEVLCGPRVGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 585 - DNA, 1569 bp, Artificial Sequence
  Synthetic polynucleotide
atgatgtattgcggtgggaatgaggtgttgtgcgggccgcgggttggctcgagcggtggcagcggtggctctggtggtctgagcggccgttccgataatcatggcggcggttctgaagtgcagctggtggaatctgggggcggactggtgcagcctaagggcagcctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggacagattcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgccggtggtggtggtagtggtggcggtggttcaggcggtggcggtagccaggctgtcgtgacacaggaaagcgccctgaccaccagccctggcgagacagtgaccctgacctgtagaagcagcacaggcgccgtgaccacaagcaactacgccaattgggtgcaggaaaagcccgaccacctgttcaccggcctgatcggcggcaccaacaaaagggctccaggcgtgccagccagattcagcggctccctgatcggagataaggccgccctgacaatcactggcgcccagaccgaggacgaggccatctacttttgcgccctgtggtacagcaacctgtgggtgttcggcggaggcaccaagctgaccgtgctgggcggctccctggaccctaagtcatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 586 - protein, 523 aa, Artificial Sequence
  Synthetic polypeptide
MMYCGGNEVLCGPRVGSSGGSGGSGGLSGRSDNHGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAGGGGSGGGGSGGGGSQAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLGGSLDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 249 aa, Artificial Sequence
  Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 588 - protein, 249 aa, Artificial Sequence
  Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 589 - protein, 96 aa, Artificial Sequence
  Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFT

SEQ ID NO: 590 - protein, 112 aa, Artificial Sequence
  Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQG

SEQ ID NO: 591 - protein, 119 aa, Artificial Sequence
  Synthetic polypeptide
QVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYCARYYDDHYCLDYWGQGTPVTVSS

SEQ ID NO: 592 - protein, 119 aa, Artificial Sequence
  Synthetic polypeptide
QVQLVESGGGVVQPGRSLRLSCSSSGYTFTRYTMHWVRQAPGKGLEWVAYINPSRGYTNYNQKFKDRFTISRDNSKNTLFLQMDSLRPEDTGVYFCARYYDDHYCLDYWGQGTPVTVSS

SEQ ID NO: 593 - protein, 96 aa, Artificial Sequence
  Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFT

SEQ ID NO: 594 - protein, 107 aa, Artificial Sequence
  Synthetic polypeptide
QIVMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 595 - protein, 107 aa, Artificial Sequence
  Synthetic polypeptide
DIQMTQSPSSLSASVGDRVTITCSASSSVSYMNWYQQTPGKAPKLLIYDTSKLASGVPSRFSGSGSGTDYTFTISSLQPEDIATYYCQQWSSNPFTFGQGTKLQITR

SEQ ID NO: 596 - protein, 119 aa, Artificial Sequence [sequence omitted]

SEQ ID NO: 597 - protein, 116 aa, Artificial Sequence
  Synthetic polypeptide
EVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSS

SEQ ID NO: 598 - protein, 107 aa, Artificial Sequence
  Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 599 - protein, 107 aa, Artificial Sequence
  Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 600 - protein, 108 aa, Artificial Sequence
  Synthetic polypeptide
DIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKR

SEQ ID NO: 601 - protein, 139 aa, Artificial Sequence
  Synthetic polypeptide
MGWSWIFLFLLSGTAGVHSQVQLVQSGAEVKKPGASVKVSCKASGYTFISYTMHWVRQAPGQGLEWMGYINPRSGYTHYNQKLKDKATLTADKSASTAYMELSSLRSEDTAVYYCARSAYYDYDGFAYWGQGTLVTVSS

SEQ ID NO: 602 - protein, 126 aa, Artificial Sequence
  Synthetic polypeptide
METDTLLLWVLLLWVPGSTGDIQMTQSPSSLSASVGDRVTITCSASSSVSYMNWYQQKPGKAPKRLIYDTSKLASGVPSRFSGSGSGTDFTLTISSLQPEDFATYYCQQWSSNPPTFGGGTKVEIK

SEQ ID NO: 603 - protein, 122 aa, Artificial Sequence [sequence omitted]

SEQ ID NO: 604 - protein, 107 aa, Artificial Sequence [sequence omitted]

SEQ ID NO: 605 - protein, 469 aa, Artificial Sequence
  Synthetic polypeptide
MGWSCIILFLVATATGVHSEVQLVESGGGLVQPGGSLRLSCATSGYTFTEYTMHWMRQAPGKGLEWVAGINPKNGGTSHNQRFMDRFTISVDKSTSTAYMQMNSLRAEDTAVYYCARWRGLNYGFDVRYFDVWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 606 - protein, 232 aa, Artificial Sequence
  Synthetic polypeptide
EVQLVESGGGLVQPGGSLRLSCATSGYTFTEYTMHWMRQAPGKGLEWVAGINPKNGGTSYADSVKGRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 607 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 608 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTLAVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 609 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSTSTAYMQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 610 - protein, 235 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSTSTAYMQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 611 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSKNTLYMELRSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 612 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSKNTLYLQMNSLTSEDSGIYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 613 - protein, 232 aa, Artificial Sequence
  Synthetic polypeptide
EVQLVESGGGLVQPGGSLRLSCATSGYTFTEYTMHWMRQAPGKGLEWVAGINPKNGGTSHNQRFMDRFTISVDKSKNTLYLQMNSLRAEDTAVYYCARWRGLNYGFDVRYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 614 - protein, 232 aa, Artificial Sequence
  Synthetic polypeptide
EVQLQQSGPELVQPGGSLRLSCATSGYTFTEYTMHWMRQAPGKGLEWVAGINPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 615 - protein, 232 aa, Artificial Sequence
  Synthetic polypeptide
EVQLVESGGGLVKPGASLRLSCATSGYTFTEYTMHWMRQAPGKGLEWVAGINPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 616 - protein, 232 aa, Artificial Sequence
  Synthetic polypeptide
EVQLVESGGGLVQPGGSLKISCKTSGYTFTEYTMHWMRQAPGKGLEWVAGINPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 617 - protein, 232 aa, Artificial Sequence
  Synthetic polypeptide
EVQLVESGGGLVQPGGSLRLSCATSGYTFTEYTMHWMKQSHGKSLEWVAGINPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 618 - protein, 232 aa, Artificial Sequence
  Synthetic polypeptide
EVQLVESGGGLVQPGGSLRLSCATSGYTFTEYTMHWMRQAPGKGLEWIGGFNPKNGGTSHNQRFMDRFTISVDKSKNTLYLQMNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 619 - protein, 233 aa, Artificial Sequence
  Synthetic polypeptide
MGWSCIILFLVATATGVHSDIQMTQSPSSLSASVGDRVTITCRASQDINNYLNWYQQKPGKAPKLLIYYTSTLHSGVPSRFSGSGSGTDYTLTISSLQPEDFATYYCQQGNTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 620 - protein, 214 aa, Artificial Sequence
  Synthetic polypeptide
DIQMTQSPSSLSASVGDRVTITCRASQDINNYLNWYQQKPGKAPKLLIYYTSTLESGVPSRFSGSGSGTDYTLTISSLQPEDFATYYCQQGNTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 621 - protein, 214 aa, Artificial Sequence
  Synthetic polypeptide
DIQMTQSPSSLSASVGDRVTITCRASQDINNYLNWYQQKPGKAPKLLIYYTSTLHSGVPSRFSGSGSGTDYTLTISSLQPEDFATYYCQQGNTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 468 aa, Artificial Sequence
  Synthetic polypeptide
MERHWIFLLLLSVTAGVHSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 623 - protein, 235 aa, Artificial Sequence
  Synthetic polypeptide
MDFQVQIFSFLLISASVIISRGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRADTAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 624 - protein, 119 aa, Artificial Sequence [sequence omitted]

SEQ ID NO: 625 - protein, 130 aa, Artificial Sequence
  Synthetic polypeptide
DFMLTQPHSVSESPGKTVIISCTLSSGNIENNYVHWYQQRPGRAPTTVIFDDDKRPDGVPDRFSGSIDRSSNSASLTISGLQTEDEADYYCHSYVSSFNVFGGGTKLTVLGQPKAAPSVTLFPPSSEELQ

SEQ ID NO: 626 - protein, 449 aa, Artificial Sequence
  Synthetic polypeptide
EVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 111 aa, Artificial Sequence
  Synthetic polypeptide
QAVVTQANSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLR

SEQ ID NO: 628 - protein, 216 aa, Artificial Sequence
  Synthetic polypeptide
QAVVTQANSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 629 - protein, 125 aa, Artificial Sequence
  Synthetic polypeptide
EVKLVESGGGLVQPGGSLRLSCAASGFTFNTYAMNWVRQAPGKGLEWVARIRSKYNNYATYYADSVKDRFTISRDDSKSSLYLQMNNLKTEDTAMYYCVRHGNFGNSYVSWFAYWGQGTLVTVSS

SEQ ID NO: 630 - protein, 125 aa, Artificial Sequence
  Synthetic polypeptide
EVKLVESGGGLVKPGRSLRLSCAASGFTFNTYAMNWVRQAPGKGLEWVARIRSKYNNYATYYADSVKDRFTISRDDSKSILYLQMNNLKTEDTAMYYCVRHGNFGNSYVSWFAYWGQGTLVTVSS

SEQ ID NO: 631 - protein, 125 aa, Artificial Sequence
  Synthetic polypeptide
EVKLVESGGGLVKPGRSLRLSCAASGFTFNTYAMNWVRQAPGKGLEWVARIRSKYNNYATYYADSVKDRFTISRDDSKSILYLQMNSLKTEDTAMYYCVRHGNFGNSYVSWFAYWGQGTLVTVSS

SEQ ID NO: 632 - protein, 125 aa, Artificial Sequence
  Synthetic polypeptide
EVKLVESGGGLVKPGRSLRLSCAASGFTFNTYAMNWVRQAPGKGLEWVARIRSKYNNYATYYADSVKDRFTISRDDSKSILYLQMNSLKTEDTAMYYCVRHGNFGNSYVSWFAYWGQGTMVTVSS

SEQ ID NO: 633-635 - skipped (3 entries)

SEQ ID NO: 636 - protein, 123 aa, Artificial Sequence
  Synthetic polypeptide
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 637 - protein, 123 aa, Artificial Sequence
  Synthetic polypeptide
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 638 - protein, 118 aa, Artificial Sequence
  Synthetic polypeptide
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 639 - protein, 118 aa, Artificial Sequence
  Synthetic polypeptide
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 640 - protein, 119 aa, Artificial Sequence
  Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 641 - protein, 108 aa, Artificial Sequence
  Synthetic polypeptide
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 642 - protein, 107 aa, Artificial Sequence
  Synthetic polypeptide
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 643 - protein, 107 aa, Artificial Sequence
  Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 644 - protein, 107 aa, Artificial Sequence
  Synthetic polypeptide
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 645 - protein, 107 aa, Artificial Sequence
  Synthetic polypeptide
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 646 - protein, 106 aa, Artificial Sequence
  Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 647 - protein, 119 aa, Artificial Sequence
  Synthetic polypeptide
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYCLDYWGQGTLVTVSS

SEQ ID NO: 648 - protein, 119 aa, Artificial Sequence
  Synthetic polypeptide
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYSLDYWGQGTLVTVSS

SEQ ID NO: 649 - protein, 106 aa, Artificial Sequence
  Synthetic polypeptide
EIVLTQSPATLSLSPGERATLSCSASSSVSYMNWYQQKPGQAPRLLIYDTSKLASGVPAHFRGSGSGTDYTLTISSLEPEDFAVYYCQQWSSNPFTFGQGTKVEIK

SEQ ID NO: 650 - protein, 106 aa, Artificial Sequence [sequence omitted]

SEQ ID NO: 651 - protein, 119 aa, Artificial Sequence
  Synthetic polypeptide
QVQLVQSGSELKKPGASVKMSCKASGYTFTRYTMHWVRQAPGKGLEWIGYINPSRGYTNYNQKFKDRATLTTDKSTSTAYMQLSSLRSEDTAVYYCARYYDDHYSLDYWGQGTLVTVSS

SEQ ID NO: 652 - protein, 106 aa, Artificial Sequence
  Synthetic polypeptide
QIVLTQSPATLSLSPGERATMSCSASSSVSYMNWYQQKPGKAPKRWIYDTSKLASGVPSRFRGSGSGTDYTLTISSLQPEDFATYYCQQWSSNPFTFGGGTKVEIK

SEQ ID NO: 653 - protein, 125 aa, Artificial Sequence
  Synthetic polypeptide
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCARHGNFGNSYVSWFAYWGQGTLVTVSS

SEQ ID NO: 654 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCARHGNFGNSYVSWFAYWGQGTLVTVSS

SEQ ID NO: 655 - protein, 125 aa, Artificial Sequence
  Synthetic polypeptide
EVQLVESGGGLVQPGGSLRLSCAASGFTFSTYAMNWVRQAPGKGLEWVARIRSKYNNYATYYADSVKDRFTISRDDSKNSLYLQMNSLKTEDTAVYYCARHGNFGNSYVSWFAYWGQGTLVTVSS

SEQ ID NO: 656 - protein, 125 aa, Artificial Sequence
  Synthetic polypeptide
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 657 - protein, 125 aa, Artificial Sequence
  Synthetic polypeptide
EVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCARHGNFGNSYVSWFAYWGQGTLVTVSS

SEQ ID NO: 658 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 659 - protein, 125 aa, Artificial Sequence
  Synthetic polypeptide
EVQLVESGGGLVQPGGSLRLSCAASGFTFNTYAMNWVRQAPGKGLEWVGRIRNKYNNYATEYADSVKDRFTISRDDSKNSLYLQMNSLKTEDTAVYYCVRHGNFGNSYVSWFAYWGQGTLVTVSS

SEQ ID NO: 660 - protein, 125 aa, Artificial Sequence
  Synthetic polypeptide
EVQLVESGGGLVQPGGSLRLSCAASGFTFSTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSS

SEQ ID NO: 661 - protein, 125 aa, Artificial Sequence
  Synthetic polypeptide
EVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSS

SEQ ID NO: 662 - protein, 125 aa, Artificial Sequence
  Synthetic polypeptide
EVQLVESGGGLVQPGGSLRLSCAASGFTFNTYAMNWVRQAPGKGLEWVARIRNKYNNYATEYADSVKDRFTISRDDSKNSLYLQMNSLKTEDTAVYYCVRHGNFGNSYVSWFAYWGQGTLVTVSS

SEQ ID NO: 663 - protein, 125 aa, Artificial Sequence
  Synthetic polypeptide
EVQLVESGGGLVQPGGSLRLSCAASGFTFNTYAMNWVRQAPGKGLEWVARTRSKANSYTTYYAASVKGRFTISRDDSKNSLYLQMNSLKTEDTAVYYCARHGNFGNSYVSWFAYWGQGTLVTVSS

SEQ ID NO: 664 - protein, 125 aa, Artificial Sequence
  Synthetic polypeptide
EVQLVESGGGLVQPGGSLRLSCAASGFTFNTYAMNWVRQAPGKGLEWVGRTRSKANSYTTYYAASVKGRFTISRDDSKNSLYLQMNSLKTEDTAVYYCARHGNFGNSYVSWFAYWGQGTLVTVSS

SEQ ID NO: 665 - protein, 125 aa, Artificial Sequence
  Synthetic polypeptide
EVQLVESGGGLVQPGGSLRLSCAASGFTFNTYAMNWVRQAPGKGLEWVGRIRSKYNNYATEYAASVKDRFTISRDDSKNSLYLQMNSLKTEDTAVYYCVRHGNFGNSYVSWFAYWGQGTLVTVSS

SEQ ID NO: 666 - protein, 125 aa, Artificial Sequence
  Synthetic polypeptide
EVQLVESGGGLVQPGGSLRLSCAASGFTFNTYAMNWVRQAPGKGLEWVARIRNKYNNYATEYAASVKDRFTISRDDSKNSLYLQMNSLKTEDTAVYYCVRHGNFGNSYVSWFAYWGQGTLVTVSS

SEQ ID NO: 667 - protein, 125 aa, Artificial Sequence; identical to SEQ ID NO: 664
  Synthetic polypeptide

SEQ ID NO: 668 - protein, 125 aa, Artificial Sequence; identical to SEQ ID NO: 663
  Synthetic polypeptide

SEQ ID NO: 669 - protein, 121 aa, Artificial Sequence
  Synthetic polypeptide
QVQLVQSGAEVKKPGASVKVSCKASGYTFTRSTMHWVRQAPGQGLEWIGYINPSSAYTNYNQKFKDRVTITADKSTSTAYMELSSLRSEDTAVYYCASPQVHYDYNGFPYWGQGTLVTVSS

SEQ ID NO: 670 - protein, 110 aa, Artificial Sequence
  Synthetic polypeptide
QAVVTQEPSLTVSPGGTVTLTCRSSTGAVTTSNYANWFQQKPGQAPRTLIGGTNKRAPWTPARFSGSLLGGKAALTITGAQAEDEADYYCALWYSNLWVFGGGTKLTVLG

SEQ ID NO: 671 - protein, 110 aa, Artificial Sequence
  Synthetic polypeptide
QAVVTQEPSLTVSPGGTVTLTCRSSTGAVTTSNYANWVQQKPGQAPRTLIGGTNKRAPWTPARFSGSLLGGKAALTITGAQAEDEADYYCALWYSNLWVFGGGTKLTVLG

SEQ ID NO: 672 - protein, 110 aa, Artificial Sequence
  Synthetic polypeptide
QAVVTQEPSLTVSPGGTVTLTCRSSTGAVTTSNYANWFQEKPGQAPRTLIGGTNKRAPWTPARFSGSLLGGKAALTITGAQAEDEADYYCALWYSNLWVFGGGTKLTVLG

SEQ ID NO: 673 - protein, 110 aa, Artificial Sequence
  Synthetic polypeptide
QAVVTQEPSLTVSPGGTVTLTCRSSTGAVTTSNYANWFQQKPGQAPRGLIGGTNKRAPWTPARFSGSLLGGKAALTITGAQAEDEADYYCALWYSNLWVFGGGTKLTVLG

SEQ ID NO: 674 - protein, 110 aa, Artificial Sequence
  Synthetic polypeptide
QAVVTQEPSLTVSPGGTVTLTCRSSTGAVTTSNYANWVQEKPGQAPRTLIGGTNKRAPWTPARFSGSLLGGKAALTITGAQAEDEADYYCALWYSNLWVFGGGTKLTVLG

SEQ ID NO: 675 - protein, 110 aa, Artificial Sequence
  Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLG

SEQ ID NO: 676 - protein, 110 aa, Artificial Sequence
  Synthetic polypeptide
QAVVTQEPSLTVSPGGTVTLTCRSSTGAVTTSNYANWFQEKPGQAPRGLIGGTNKRAPWTPARFSGSLLGGKAALTITGAQAEDEADYYCALWYSNLWVFGGGTKLTVLG

SEQ ID NO: 677 - protein, 110 aa, Artificial Sequence
  Synthetic polypeptide
QAVVTQEPSLTVSPGGTVTLTCRSSTGAVTTSNYANWVQEKPGQAPRGLIGGTNKRAPWTPARFSGSLLGGKAALTITGAQAEDEADYYCALWYSNLWVFGGGTKLTVLG

SEQ ID NO: 678 - protein, 110 aa, Artificial Sequence
  Synthetic polypeptide
QAVVTQEPSLTVSPGGTVTLTCRSSTGAVTTSNYANWVQEKPGQAFRGLIGGTNKRAPWTPARFSGSLLGGKAALTITGAQAEDEADYYCALWYSNLWVFGGGTKLTVLG

SEQ ID NO: 679 - protein, 106 aa, Artificial Sequence
  Synthetic polypeptide
DIQMTQSPSSLSASVGDRVTITCSASSSVSYMNWYQQKPGKAPKRLIYDSSKLASGVPSRFSGSGSGTEFTLTISSLQPEDFATYYCQQWSRNPPTFGGGTKVEIK

SEQ ID NO: 680 - protein, 106 aa, Artificial Sequence
  Synthetic polypeptide
DVVMTQSPAIMSAFPGEKVTITCSASSSVSYMNWYQQKPGKAPKRWIYDSSKLASGVPSRFSGSGSGTEFTLTISSLQPEDFATYYCQQWSRNPPTFGGGTKVEIK

SEQ ID NO: 681 - protein, 121 aa, Artificial Sequence
  Synthetic polypeptide
QVQLVQSGAEVKKPGASVKVSCKASGYTFTRSTMHWVKQAPGQGLEWIGYINPSSAYTNYNQKFKDKATLTADKSSSTAYMQLSSLRSEDTAVYYCARPQVHYDYNGFPYWGQGTLVTVSS

SEQ ID NO: 682 - protein, 121 aa, Artificial Sequence
  Synthetic polypeptide
QVQLVQSGGGVVQPGRSLRLSCKASGYTFTRSTMHWVRQAPGKGLEWIGYINPSSAYTNYNQKFKDKATLTADKSKNTAYMELSSLRSEDTAVYYCARPQVHYDYNGFPYWGQGTLVTVSS

SEQ ID NO: 683 - protein, 121 aa, Artificial Sequence
  Synthetic polypeptide
QVQLVQSGGGVVQPGRSLRLSCKASGYTFTRSTMHWVRQAPGKGLEWIGYINPSSAYTNYNQKFKDRFTISADKSKSTAFLQMDSLRPEDTGVYFCARPQVHYDYNGFPYWGQGTPVTVSS

SEQ ID NO: 684 - protein, 121 aa, Artificial Sequence
  Synthetic polypeptide
QVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSS

SEQ ID NO: 685 - protein, 121 aa, Artificial Sequence
  Synthetic polypeptide
QVQLVQSGAEVKKPGASVKVSCKASGYTFTRSTMHWVRQAPGQRLEWMGYINPSSAYTNYNQKFKDRVTITRDTSASTAYMELSSLRSEDTAVYYCARPQVHYDYNGFPYWGQGTLVTVSS

SEQ ID NO: 686 - protein, 121 aa, Artificial Sequence
  Synthetic polypeptide
EVQLVESGGGLVKPGGSLRLSCAASGFTFSRSTMHWVRQAPGKGLEWVSYINPSSAYTNYNQKFKDRFTISRDNAKNSLYLQMNSLRAEDTAVYYCARPQVHYDYNGFPYWGQGTLVTVSS

SEQ ID NO: 687 - protein, 108 aa, Artificial Sequence
  Synthetic polypeptide
AQDIQMTQSPSSLSASVGDRVTMTCSASSSVSYMNWYQQKPGKAPKLLIYDSSKLASGVPARFSGSGSGTDYTLTISSLQPEDFATYYCQQWSRNPPTFGGGTKVEIK

SEQ ID NO: 688 - protein, 106 aa, Artificial Sequence
  Synthetic polypeptide
EIVLTQSPATLSLSPGERATLSCSASSSVSYMNWYQQKPGQAPRLLIYDSSKLASGIPARFSGSGSGTDFTLTISSLEPEDFAVYYCQQWSRNPPTFGGGTKVEIK

SEQ ID NO: 689 - protein, 108 aa, Artificial Sequence
  Synthetic polypeptide
AQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQIT

SEQ ID NO: 690 - protein, 108 aa, Artificial Sequence
  Synthetic polypeptide
AQDIQMTQSPSSLSASVGDRVTITCSASSSVSYMNWYQQTPGKAPKRWIYDSSKLASGVPSRFSGSGSGTDFTLTISSLQPEDIATYYCQQWSRNPPTFGQGTKLQIT

SEQ ID NO: 691 - protein, 118 aa, Artificial Sequence [sequence omitted]

SEQ ID NO: 692 - protein, 118 aa, Artificial Sequence
  Synthetic polypeptide
QVQLVQSGGGVVQSGRSLRLSCAASGFKFSGYGMHWVRQAPGKGLEWVAVIWYDGSKKYYVDSVKGRFTISRDNSKNTLYLQMNSLRGEDTAVYYCARQMGYWHFDLWGRGTLVTVSS

SEQ ID NO: 693 - protein, 118 aa, Artificial Sequence
  Synthetic polypeptide
QVQLVESGGGVVQPGRSLRLSCAASGFTFRSYGMHWVRQAPGKGLEWVAIIWYDGSKKNYADSVKGRFTISRDNSKNTLYLQMNSLRAEDTAVYYCARGTGYNWFDPWGQGTLVTVSS

SEQ ID NO: 694 - protein, 118 aa, Artificial Sequence
  Synthetic polypeptide
QVQLVQSGGGVVQPGRSLRLSCVASGFTFSSYGMHWVRQAPGKGLEWVAAIWYNGRKQDYADSVKGRFTISRDNSKNTLYLQMNSLRAEDTAVYYCTRGTGYNWFDPWGQGTLVTVSS

SEQ ID NO: 695 - protein, 108 aa, Artificial Sequence [sequence omitted]

SEQ ID NO: 696 - protein, 108 aa, Artificial Sequence
  Synthetic polypeptide
EIVLTQSPRTLSLSPGERATLSCRASQSVSSSYLAWYQQKPGQAPRLLIYGASSRATGIPDRFSGSGSGTDFTLTISRLDPEDFAVYYCQQYGSSPITFGQGTRLEIK

SEQ ID NO: 697 - protein, 106 aa, Artificial Sequence
  Synthetic polypeptide
DILMTQSPSSLSASVGDRVTITCRASQGISSALAWYQQKPGKAPKLLIYYASSLQSGVPSRFSGSGSGTDYTLTISSLQPEDFATYYCQQYYSTLTFGGGTKVEIK

SEQ ID NO: 698 - protein, 106 aa, Artificial Sequence
  Synthetic polypeptide
DIVMTQSPSSLSASVGDRVTITCRASQGISSALAWYQQKPGKAPKLLIYDASSLGSGVPSRFSGSGSGTDFTLTISSLQPEDFATYYCQQYYSTLTFGGGTKVEIK

SEQ ID NO: 699 - protein, 106 aa, Artificial Sequence
  Synthetic polypeptide
DIQMTQSPFSLSASVGDRVTITCWASQGISSYLAWYQQKPAKAPKLFIYYASSLQSGVPSRFSGSGSGTDYTLTISSLQPEDFATYYCQQYYSTLTFGGGTKVEIK

SEQ ID NO: 700 - protein, 106 aa, Artificial Sequence
  Synthetic polypeptide
DIEMTQSPFSLSASVGDRVTITCWASQGISSYLAWYQQKPAKAPKLFIYYASSLQSGVPSRFSGSGSGTDYTLTISSLQPEDFATYYCQQYYSTLTFGGGTKVEIK

SEQ ID NO: 701 - protein, 107 aa, Artificial Sequence
  Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 702 - protein, 107 aa, Artificial Sequence
  Synthetic polypeptide
AIQLTQSPSSLSASVGDRVTITCRASQGISSALAWYQQKPGKAPKLLIYDASSLESGVPSRFSGSGSGTDFTLTISSLQPEDFATYYCQQFNSYPITFGQGTRLEIK

SEQ ID NO: 703 - protein, 120 aa, Artificial Sequence [sequence omitted]

SEQ ID NO: 704 - protein, 106 aa, Artificial Sequence [sequence omitted]

SEQ ID NO: 705 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 706 - protein, 125 aa, Artificial Sequence
  Synthetic polypeptide
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 707 - protein, 125 aa, Artificial Sequence
  Synthetic polypeptide
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 708 - protein, 125 aa, Artificial Sequence
  Synthetic polypeptide
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 709 - protein, 125 aa, Artificial Sequence
  v
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 710 - protein, 125 aa, Artificial Sequence
  Synthetic polypeptide
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 711 - protein, 125 aa, Artificial Sequence
  Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 712 - protein, 125 aa, Artificial Sequence
  Synthetic polypeptide
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 713 - protein, 125 aa, Artificial Sequence
  Synthetic polypeptide
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 714 - protein, 125 aa, Artificial Sequence
  Synthetic polypeptide
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 715 - protein, 125 aa, Artificial Sequence
  Synthetic polypeptide
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSS

SEQ ID NO: 716 - protein, 125 aa, Artificial Sequence
  Synthetic polypeptide
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSS

SEQ ID NO: 717 - protein, 125 aa, Artificial Sequence
  Synthetic polypeptide
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSS

SEQ ID NO: 718 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSS

SEQ ID NO: 719 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSS

SEQ ID NO: 720 - protein, 123 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTV

SEQ ID NO: 721 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSS

SEQ ID NO: 722 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSS

SEQ ID NO: 723 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSS

SEQ ID NO: 724 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSS

SEQ ID NO: 725 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSS

SEQ ID NO: 726 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSS

SEQ ID NO: 727 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 728 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 729 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSS

SEQ ID NO: 730 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSS

SEQ ID NO: 731 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSS

SEQ ID NO: 732 - protein, 125 aa, Artificial Sequence
  Synthetic polypeptide
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSS

SEQ ID NO: 733 - protein, 125 aa, Artificial Sequence
  Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSS

SEQ ID NO: 734 - protein, 125 aa, Artificial Sequence
  Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 735 - protein, 125 aa, Artificial Sequence
  Synthetic polypeptide
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 736 - protein, 125 aa, Artificial Sequence
  Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 737 - protein, 125 aa, Artificial Sequence
  Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 738 - protein, 125 aa, Artificial Sequence
  Synthetic polypeptide
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 739 - protein, 125 aa, Artificial Sequence
  Synthetic polypeptide
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 740 - protein, 123 aa, Artificial Sequence
  Synthetic polypeptide
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSS

SEQ ID NO: 741 - protein, 125 aa, Artificial Sequence
  Synthetic polypeptide
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 742 - protein, 125 aa, Artificial Sequence
  Synthetic polypeptide
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 743 - protein, 125 aa, Artificial Sequence
  Synthetic polypeptide
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 744 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 745 - protein, 109 aa, Artificial Sequence
  Synthetic polypeptide
QAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 746 - protein, 109 aa, Artificial Sequence
  Synthetic polypeptide
QAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 747 - protein, 109 aa, Artificial Sequence
  Synthetic polypeptide
QAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 748 - protein, 109 aa, Artificial Sequence
  Synthetic polypeptide
QAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 749 - protein, 109 aa, Artificial Sequence
  Synthetic polypeptide
QAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 750 - protein, 109 aa, Artificial Sequence
  Synthetic polypeptide
QAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 751 - protein, 109 aa, Artificial Sequence
  Synthetic polypeptide
QAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 752 - protein, 109 aa, Artificial Sequence
  Synthetic polypeptide
QAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 753 - protein, 109 aa, Artificial Sequence
  Synthetic polypeptide
QAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 754 - protein, 109 aa, Artificial Sequence
  Synthetic polypeptide
QAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 755 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 756 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 757 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 758 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 759 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 760 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 761 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 762 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 763 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 764 - protein, 111 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 765 - protein, 112 aa, Artificial Sequence
  Synthetic polypeptide
EIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 766 - protein, 112 aa, Artificial Sequence
  Synthetic polypeptide
DIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 767 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 768 - protein, 109 aa, Artificial Sequence
  Synthetic polypeptide
QAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 769 - protein, 107 aa, Artificial Sequence
  Synthetic polypeptide
QAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLT

SEQ ID NO: 770 - protein, 109 aa, Artificial Sequence
  Synthetic polypeptide
QAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 771 - protein, 109 aa, Artificial Sequence
  Synthetic polypeptide
QAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 772 - protein, 109 aa, Artificial Sequence
  Synthetic polypeptide
QAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 773 - protein, 109 aa, Artificial Sequence
  Synthetic polypeptide
QAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 774 - protein, 109 aa, Artificial Sequence
  Synthetic polypeptide
QAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 775 - protein, 109 aa, Artificial Sequence
  Synthetic polypeptide
QAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 776 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 777 - protein, 109 aa, Artificial Sequence
  Synthetic polypeptide
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 778 - protein, 109 aa, Artificial Sequence
  Synthetic polypeptide
QAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 779 - protein, 109 aa, Artificial Sequence
  Synthetic polypeptide
QAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 780 - protein, 109 aa, Artificial Sequence
  Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 781 - protein, 109 aa, Artificial Sequence
  Synthetic polypeptide
QAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 782 - protein, 109 aa, Artificial Sequence
  Synthetic polypeptide
QAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 783 - protein, 109 aa, Artificial Sequence
  Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 784 - protein, 12 aa, Artificial Sequence
  Synthetic oligopeptide
TLSSGNIENYVH

SEQ ID NO: 785 - protein, 7 aa, Artificial Sequence
  Synthetic oligopeptide
DDDKRPD

SEQ ID NO: 786 - protein, 9 aa, Artificial Sequence
  Synthetic oligopeptide
HSYVSSFNV

SEQ ID NO: 787 - protein, 5 aa, Artificial Sequence
  Synthetic oligopeptide
SFPMA

SEQ ID NO: 788 - protein, 17 aa, Artificial Sequence
  Synthetic oligopeptide
TISTSGGRTYYRDSVKG

SEQ ID NO: 789 - protein, 10 aa, Artificial Sequence
  Synthetic oligopeptide
FRQYSGGFDY

SEQ ID NO: 790 - protein, 13 aa, Artificial Sequence
  Synthetic oligopeptide
TLSSGNIENNYVH

SEQ ID NO: 791 - protein, 8 aa, Artificial Sequence
  Synthetic oligopeptide
GFTFNTYA

SEQ ID NO: 792 - protein, 10 aa, Artificial Sequence
  Synthetic oligopeptide
IRSKYNNYAT

SEQ ID NO: 793 - protein, 16 aa, Artificial Sequence
  Synthetic oligopeptide
VRHGNFGNSYVSWFAY

SEQ ID NO: 794 - protein, 9 aa, Artificial Sequence
  Synthetic oligopeptide
TGAVTTSNY

SEQ ID NO: 795 - skipped

SEQ ID NO: 796 - protein, 5 aa, Artificial Sequence
  Synthetic oligopeptide
RYTMH

SEQ ID NO: 797 - protein, 17 aa, Artificial Sequence
  Synthetic oligopeptide
YINPSRGYTNYNQKFKD

SEQ ID NO: 798 - protein, 10 aa, Artificial Sequence
  Synthetic oligopeptide
YYDDHYSLDY

SEQ ID NO: 799 - protein, 10 aa, Artificial Sequence
  Synthetic oligopeptide
SASSSVSYMN

SEQ ID NO: 800 - protein, 7 aa, Artificial Sequence
  Synthetic oligopeptide
DTSKLAS

SEQ ID NO: 801 - protein, 9 aa, Artificial Sequence
  Synthetic oligopeptide
QQWSSNPFT

SEQ ID NO: 802 - protein, 5 aa, Artificial Sequence
  Synthetic oligopeptide
SYGMH

SEQ ID NO: 803 - protein, 17 aa, Artificial Sequence
  Synthetic oligopeptide
VISYDGSNKYYADSVKG

SEQ ID NO: 804 - protein, 16 aa, Artificial Sequence
  Synthetic oligopeptide
LSPYCTNGVCWDAFDI

SEQ ID NO: 805 - protein, 11 aa, Artificial Sequence
  Synthetic oligopeptide
RASQTISNYLN

SEQ ID NO: 806 - protein, 7 aa, Artificial Sequence
  Synthetic oligopeptide
AASTLQS

SEQ ID NO: 807 - protein, 9 aa, Artificial Sequence
  Synthetic oligopeptide
QQFNSYPRT

SEQ ID NO: 808 - protein, 5 aa, Artificial Sequence
  Synthetic oligopeptide
DYAMS

SEQ ID NO: 809 - protein, 19 aa, Artificial Sequence
  Synthetic oligopeptide
FIRSKAYGGTTEYAASVKG

SEQ ID NO: 810 - protein, 11 aa, Artificial Sequence
  Synthetic oligopeptide
QLWLLQDAFDI

SEQ ID NO: 811 - protein, 11 aa, Artificial Sequence
  Synthetic oligopeptide
RASQGISNYLA

SEQ ID NO: 812 - protein, 9 aa, Artificial Sequence
  Synthetic oligopeptide
QQSYSTPPT

SEQ ID NO: 813 - protein, 6 aa, Artificial Sequence
  Synthetic oligopeptide
SRNWWS

SEQ ID NO: 814 - protein, 16 aa, Artificial Sequence
  Synthetic oligopeptide
DIYHSGSTNYNPSLKS

SEQ ID NO: 815 - protein, 11 aa, Artificial Sequence
  Synthetic oligopeptide
GYTSCRDAFDI

SEQ ID NO: 816 - protein, 11 aa, Artificial Sequence
  Synthetic oligopeptide
RASQGIGNYLA

SEQ ID NO: 817 - protein, 7 aa, Artificial Sequence
  Synthetic oligopeptide
WASIRES

SEQ ID NO: 818 - protein, 9 aa, Artificial Sequence
  Synthetic oligopeptide
QQYYSNPQT

SEQ ID NO: 819 - protein, 5 aa, Artificial Sequence
  Synthetic oligopeptide
GYYWS

SEQ ID NO: 820 - protein, 16 aa, Artificial Sequence
  Synthetic oligopeptide
EINHSGSTNYNPSLKS

SEQ ID NO: 821 - protein, 18 aa, Artificial Sequence
  Synthetic oligopeptide
GRGRFLGWLLGGSNWFDP

SEQ ID NO: 822 - protein, 11 aa, Artificial Sequence
  Synthetic oligopeptide
RASQGISNYLN

SEQ ID NO: 823 - protein, 7 aa, Artificial Sequence
  Synthetic oligopeptide
DASNLET

SEQ ID NO: 824 - protein, 9 aa, Artificial Sequence
  Synthetic oligopeptide
QQSYSTPYT

SEQ ID NO: 825 - protein, 11 aa, Artificial Sequence
  Synthetic oligopeptide
GPDRMGHGFDI

SEQ ID NO: 826 - protein, 11 aa, Artificial Sequence
  Synthetic oligopeptide
RASQSISSYLN

SEQ ID NO: 827 - protein, 7 aa, Artificial Sequence
  Synthetic oligopeptide
QQSYSSP

SEQ ID NO: 828 - protein, 7 aa, Artificial Sequence
  Synthetic oligopeptide
SNSAAWN

SEQ ID NO: 829 - protein, 18 aa, Artificial Sequence
  Synthetic oligopeptide
RTYYRSKWYNDYAVSVKS

SEQ ID NO: 830 - protein, 15 aa, Artificial Sequence
  Synthetic oligopeptide
DRRRIAARQYYGMDV

SEQ ID NO: 831 - protein, 12 aa, Artificial Sequence
  Synthetic oligopeptide
RASQSVSSNYLA

SEQ ID NO: 832 - protein, 7 aa, Artificial Sequence
  Synthetic oligopeptide
GASSRAT

SEQ ID NO: 833 - protein, 7 aa, Artificial Sequence
  Synthetic oligopeptide
QKYNSAP

SEQ ID NO: 834 - protein, 5 aa, Artificial Sequence
  Synthetic oligopeptide
SYAMG

SEQ ID NO: 835 - protein, 17 aa, Artificial Sequence
  Synthetic oligopeptide
AVSGSGGSTYYADSVKG

SEQ ID NO: 836 - protein, 12 aa, Artificial Sequence
  Synthetic oligopeptide
AKFLGHYYGMDV

SEQ ID NO: 837 - protein, 9 aa, Artificial Sequence
  Synthetic oligopeptide
LQHNAYPYT

SEQ ID NO: 838 - protein, 7 aa, Artificial Sequence
  Synthetic oligopeptide
NPRMGVS

SEQ ID NO: 839 - protein, 16 aa, Artificial Sequence
  Synthetic oligopeptide
HIFPSDAKAHSASLKS

SEQ ID NO: 840 - protein, 13 aa, Artificial Sequence
  Synthetic oligopeptide
ILGEYYPPAWFDP

SEQ ID NO: 841 - protein, 17 aa, Artificial Sequence
  Synthetic oligopeptide
KSSQSVLYSSNNKNYLA

SEQ ID NO: 842 - protein, 7 aa, Artificial Sequence
  Synthetic oligopeptide
WASTRES

SEQ ID NO: 843 - protein, 9 aa, Artificial Sequence
  Synthetic oligopeptide
QQYLKIPYT

SEQ ID NO: 844 - protein, 5 aa, Artificial Sequence
  Synthetic oligopeptide
IYAMN

SEQ ID NO: 845 - protein, 19 aa, Artificial Sequence
  Synthetic oligopeptide
RIRSKYNNYATYYADSVKS

SEQ ID NO: 846 - protein, 14 aa, Artificial Sequence
  Synthetic oligopeptide
HGNFGNSYVSFFAY

SEQ ID NO: 847 - protein, 14 aa, Artificial Sequence
  Synthetic oligopeptide
GSSTGAVTSGYYPN

SEQ ID NO: 848 - protein, 7 aa, Artificial Sequence
  Synthetic oligopeptide
GTKFLAP

SEQ ID NO: 849 - protein, 9 aa, Artificial Sequence
  Synthetic oligopeptide
ALWYSNRWV

SEQ ID NO: 850 - protein, 5 aa, Artificial Sequence
  Synthetic oligopeptide
KYAMN

SEQ ID NO: 851 - protein, 14 aa, Artificial Sequence
  Synthetic oligopeptide
HGNFGNSYISYWAY

SEQ ID NO: 852 - protein, 14 aa, Artificial Sequence
  Synthetic oligopeptide
RSSTGAVTSGYYPN

SEQ ID NO: 853 - protein, 7 aa, Artificial Sequence
  Synthetic oligopeptide
ATDMRPS

SEQ ID NO: 854 - protein, 5 aa, Artificial Sequence
  Synthetic oligopeptide
SYAMN

SEQ ID NO: 855 - protein, 19 aa, Artificial Sequence
  Synthetic oligopeptide
RIRSKYNNYATYYADSVKG

SEQ ID NO: 856 - protein, 14 aa, Artificial Sequence
  Synthetic oligopeptide
HGNFGNSYLSFWAY

SEQ ID NO: 857 - protein, 14 aa, Artificial Sequence
  Synthetic oligopeptide
GSSTGAVTSGNYPN

SEQ ID NO: 858 - protein, 9 aa, Artificial Sequence
  Synthetic oligopeptide
VLWYSNRWV

SEQ ID NO: 859 - protein, 5 aa, Artificial Sequence
  Synthetic oligopeptide
RYAMN

SEQ ID NO: 860 - protein, 14 aa, Artificial Sequence
  Synthetic oligopeptide
HGNFGNSYLSYFAY

SEQ ID NO: 861 - protein, 5 aa, Artificial Sequence
  Synthetic oligopeptide
VYAMN

SEQ ID NO: 862 - protein, 19 aa, Artificial Sequence
  Synthetic oligopeptide
RIRSKYNNYATYYADSVKK

SEQ ID NO: 863 - protein, 14 aa, Artificial Sequence
  Synthetic oligopeptide
HGNFGNSYLSWWAY

SEQ ID NO: 864 - protein, 14 aa, Artificial Sequence
  Synthetic oligopeptide
HGNFGNSYTSYYAY

SEQ ID NO: 865 - protein, 5 aa, Artificial Sequence
  Synthetic oligopeptide
GYAMN

SEQ ID NO: 866 - protein, 19 aa, Artificial Sequence
  Synthetic oligopeptide
RIRSKYNNYATYYADSVKE

SEQ ID NO: 867 - protein, 14 aa, Artificial Sequence
  Synthetic oligopeptide
HRNFGNSYLSWFAY

SEQ ID NO: 868 - protein, 14 aa, Artificial Sequence
  Synthetic oligopeptide
HGNFGNSYISWWAY

SEQ ID NO: 869 - protein, 14 aa, Artificial Sequence
  Synthetic oligopeptide
HGNFGNSYVSWWAY

SEQ ID NO: 870 - protein, 5 aa, Artificial Sequence
  Synthetic oligopeptide
GYGMH

SEQ ID NO: 871 - protein, 17 aa, Artificial Sequence
  Synthetic oligopeptide
VIWYDGSKKYYVDSVKG

SEQ ID NO: 872 - protein, 9 aa, Artificial Sequence
  Synthetic oligopeptide
QMGYWHFDL

SEQ ID NO: 873 - protein, 11 aa, Artificial Sequence
  Synthetic oligopeptide
RASQSVSSYLA

SEQ ID NO: 874 - protein, 7 aa, Artificial Sequence
  Synthetic oligopeptide
DASNRAT

SEQ ID NO: 875 - protein, 10 aa, Artificial Sequence
  Synthetic oligopeptide
QQRSNWPPLT

SEQ ID NO: 876 - protein, 11 aa, Artificial Sequence
  Synthetic oligopeptide
RASQGISSALA

SEQ ID NO: 877 - protein, 7 aa, Artificial Sequence
  Synthetic oligopeptide
YASSLQS

SEQ ID NO: 878 - DNA, 2244 bp, Artificial Sequence; identical to SEQ ID NO: 451
  Synthetic polynucleotide

SEQ ID NO: 879 - protein, 711 aa, Artificial Sequence
  Synthetic polypeptide
SDNHGGGSQTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGGGSGGGGSGGGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 880 - DNA, 777 bp, Artificial Sequence
  Synthetic polynucleotide
caaggccagtctggccagtatgggtcctgcagttggaactatgtacacatattcatggattgcggctcgagcggtggcagcggtggctctggtggctcaggtggaggctcgggcggtgggagcggcggttctgacatccagatgactcagtctcctagctccctgtccgcctctgtgggggaccgagtcaccatcacatgcagagccagccaggatatttctagttacctgaactggtatcagcagaagcccggaaaagcacctaagctgctgatctactatacctccaggctgcactctggcgtgcccagtcggttcagtggctcagggagcggaaccgacttcacttttaccatctcaagcctgcagccagaggatattgccacatactattgtcagcagggcaatacactgccctacacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 881 - protein, 258 aa, Artificial Sequence
  Synthetic polypeptide
QGQSGQYGSCSWNYVHIFMDCGSSGGSGGSGGSGGGSGGGSGGSDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 882 - DNA, 2112 bp, Artificial Sequence; identical to SEQ ID NO: 459
  Synthetic polynucleotide

SEQ ID NO: 883 - protein, 703 aa, Artificial Sequence; identical to SEQ ID NO: 460
  Synthetic polypeptide

SEQ ID NO: 884-887 - skipped (4 entries)

SEQ ID NO: 888 - protein, 9 aa, Artificial Sequence
  Synthetic oligopeptide
QQYYSTLTF

SEQ ID NO: 889 - protein, 7 aa, Artificial Sequence
  Synthetic oligopeptide
DASSLGS

SEQ ID NO: 890 - protein, 11 aa, Artificial Sequence
  Synthetic oligopeptide
WASQGISSYLA

SEQ ID NO: 891 - protein, 17 aa, Artificial Sequence
  Synthetic oligopeptide
AIWYNGRKQDYADSVKG

SEQ ID NO: 892 - protein, 9 aa, Artificial Sequence
  Synthetic oligopeptide
QQRSNWPWT

SEQ ID NO: 893 - protein, 7 aa, Artificial Sequence
  Synthetic oligopeptide
DASSLES

SEQ ID NO: 894 - protein, 9 aa, Artificial Sequence
  Synthetic oligopeptide
QQFNSYPIT

SEQ ID NO: 895 - DNA, 2226 bp, Artificial Sequence
  Synthetic polynucleotide
ggttatcggtggggttgcgagtggaattgcggtgggattactactggctcgagcggtggcagcggtggctctggtggtctgagcggccgttccgataatcatggcggcggttctcagaccgtggtcacacaggagccctcactgacagtgagccctggcgggaccgtcacactgacttgtcgcagttcaactggcgccgtgactaccagcaattacgctaactgggtccagcagaaaccaggacaggcaccacgaggactgatcggaggaactaataagagagcaccaggaacccctgcaaggttctccggatctctgctggggggaaaagccgctctgacactgagcggcgtgcagcctgaggacgaagctgagtactattgcgcactgtggtactccaacctgtgggtgtttggcgggggaactaagctgaccgtcctgggaggaggaggaagcggaggaggagggagcggaggaggaggatccgaagtgcagctggtcgagagcggaggaggactggtgcagccaggaggatccctgaagctgtcttgtgcagccagtggcttcaccttcaacacttacgcaatgaactgggtgcggcaggcacctgggaagggactggaatgggtcgcccggatcagatctaaatacaataactatgccacctactatgctgacagtgtgaaggataggttcaccatttcacgcgacgatagcaaaaacacagcttatctgcagatgaataacctgaagaccgaggatacagcagtgtactattgcgtcagacacggcaatttcgggaactcttacgtgagttggtttgcctattggggacaggggacactggtcaccgtctcctcaggaggtggtggatcccaggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcaaagccaggataccgcgatttattattgcgcgcgcgcgctgacctattatgattatgaatttgcgtattggggccagggcaccctggtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtaccagagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 896 - protein, 7 aa, Artificial Sequence
  Synthetic oligopeptide
GPRSFGL

SEQ ID NO: 897 - protein, 6 aa, Artificial Sequence
  Synthetic oligopeptide
GPRSFG

SEQ ID NO: 898 - protein, 12 aa, Artificial Sequence
  Synthetic oligopeptide
NTLSGRSENHSG

SEQ ID NO: 899 - protein, 12 aa, Artificial Sequence
  Synthetic oligopeptide
NTLSGRSGNHGS

SEQ ID NO: 900 - protein, 12 aa, Artificial Sequence
  Synthetic oligopeptide
TSTSGRSANPRG

SEQ ID NO: 901 - protein, 8 aa, Artificial Sequence
  Synthetic oligopeptide
TSGRSANP

SEQ ID NO: 902 - protein, 8 aa, Artificial Sequence
  Synthetic oligopeptide
VAGRSMRP

SEQ ID NO: 903 - protein, 8 aa, Artificial Sequence
  Synthetic oligopeptide
VVPEGRRS

SEQ ID NO: 904 - protein, 8 aa, Artificial Sequence
  Synthetic oligopeptide
ILPRSPAF

SEQ ID NO: 905 - protein, 8 aa, Artificial Sequence
  Synthetic oligopeptide
MVLGRSLL

SEQ ID NO: 906 - protein, 8 aa, Artificial Sequence
  Synthetic oligopeptide
QGRAITFI

SEQ ID NO: 907 - protein, 8 aa, Artificial Sequence
  Synthetic oligopeptide
SPRSIMLA

SEQ ID NO: 908 - protein, 8 aa, Artificial Sequence
  Synthetic oligopeptide
SMLRSMPL

SEQ ID NO: 909 - protein, 13 aa, Artificial Sequence
  Synthetic oligopeptide
ISSGLLSGRSDNH

SEQ ID NO: 910 - protein, 22 aa, Artificial Sequence
  Synthetic polypeptide
ISSGLLSSGGSGGSLSGRSDNH

SEQ ID NO: 911 - protein, 22 aa, Artificial Sequence
  Synthetic polypeptide
AVGLLAPPGGTSTSGRSANPRG

SEQ ID NO: 912 - protein, 22 aa, Artificial Sequence
  Synthetic polypeptide
TSTSGRSANPRGGGAVGLLAPP

SEQ ID NO: 913 - protein, 24 aa, Artificial Sequence
  Synthetic polypeptide
VHMPLGFLGPGGTSTSGRSANPRG

SEQ ID NO: 914 - protein, 24 aa, Artificial Sequence
  Synthetic polypeptide
TSTSGRSANPRGGGVHMPLGFLGP

SEQ ID NO: 915 - protein, 18 aa, Artificial Sequence
  Synthetic oligopeptide
AVGLLAPPGGLSGRSDNH

SEQ ID NO: 916 - protein, 18 aa, Artificial Sequence
  Synthetic oligopeptide
LSGRSDNHGGAVGLLAPP

SEQ ID NO: 917 - protein, 20 aa, Artificial Sequence
  Synthetic oligopeptide
VHMPLGFLGPGGLSGRSDNH

SEQ ID NO: 918 - protein, 20 aa, Artificial Sequence
  Synthetic oligopeptide
LSGRSDNHGGVHMPLGFLGP

SEQ ID NO: 919 - protein, 22 aa, Artificial Sequence
  Synthetic polypeptide
LSGRSDNHGGSGGSISSGLLSS

SEQ ID NO: 920 - protein, 22 aa, Artificial Sequence
  Synthetic polypeptide
LSGRSGNHGGSGGSISSGLLSS

SEQ ID NO: 921 - protein, 22 aa, Artificial Sequence
  Synthetic polypeptide
ISSGLLSSGGSGGSLSGRSGNH

SEQ ID NO: 922 - protein, 22 aa, Artificial Sequence
  Synthetic polypeptide
LSGRSDNHGGSGGSQNQALRMA

SEQ ID NO: 923 - protein, 22 aa, Artificial Sequence
  Synthetic polypeptide
QNQALRMAGGSGGSLSGRSDNH

SEQ ID NO: 924 - protein, 22 aa, Artificial Sequence
  Synthetic polypeptide
LSGRSGNHGGSGGSQNQALRMA

SEQ ID NO: 925 - protein, 22 aa, Artificial Sequence
  Synthetic polypeptide
QNQALRMAGGSGGSLSGRSGNH

SEQ ID NO: 926 - protein, 13 aa, Artificial Sequence
  Synthetic oligopeptide
ISSGLLSGRSGNH

SEQ ID NO: 927 - DNA, 41 bp, Artificial Sequence
  Synthetic polynucleotide
catacactggtatcagcaaagaacacagggttctccaaggc

What is claimed is:
1. A bispecific antibody comprising the following structure:
   a. two single chain variable antibody fragments (scFvs) (each an AB1) that each specifically binds to an epsilon chain of CD3 (CD3ε), wherein each AB1 comprises a heavy chain variable region and a light chain variable region;
   wherein:
      (i) AB1 comprises a heavy chain variable region (VH) comprising the amino acid sequence of SEQ ID NO: 4 and a light chain variable region (VL) comprising the amino acid sequence of SEQ ID NO: 2;
      (ii) AB1 comprises the amino acid sequence of SEQ ID NO: 6;
      (iii) AB1 comprises the amino acid sequence of SEQ ID NO: 30;
      (iv) AB1 comprises the amino acid sequence of SEQ ID NO: 587; or
      (v) AB1 comprises the amino acid sequence of SEQ ID NO: 588; and
   b. a full length IgG1 (AB2) that specifically binds to a second target wherein the AB2 comprises two antibody heavy chains and two antibody light chains and wherein the carboxyl terminus of each AB1 is linked to the amino terminus of each heavy chain of AB2.
2. The antibody of claim 1 comprising an agent conjugated to the antibody.
3. The bispecific antibody of claim 2, wherein the agent has one or more of the following characteristics selected from the group consisting of:
   (i) the agent is a therapeutic agent, an antineoplastic agent, a toxin or fragment thereof, a detectable moiety or a diagnostic agent;
   (ii) the agent is conjugated to the antibody via a linker;
   (iii) the agent is conjugated to the antibody via a cleavable linker; and
   (iv) the agent is conjugated to the antibody via a non-cleavable linker.
4. A bispecific antibody comprising the following structure:
   a. two single chain variable antibody fragments (scFvs) (each an AB1) that each specifically binds to the epsilon chain of CD3 (CD3ε) wherein each AB1 comprises a heavy chain variable region and a light chain variable region and wherein each AB1 is linked to a masking peptide (MM1) and a cleavable peptide (CM1) that is a substrate for a first protease; wherein each MM1 is linked in an N- to C-terminal direction to a CM1, to form a MM1-CM1 peptide and wherein the carboxyl terminus each MM1-CM1 peptide is linked to the amino terminus of each AB1;
   wherein:
      (i) AB1 comprises a heavy chain variable region (VH) comprising the amino acid sequence of SEQ ID NO: 4 and a light chain variable region (VL) comprising the amino acid sequence of SEQ ID NO: 2;
      (ii) AB1 comprises the amino acid sequence of SEQ ID NO: 6;
      (iii) AB1 comprises the amino acid sequence of SEQ ID NO: 30;
      (iv) AB1 comprises the amino acid sequence of SEQ ID NO: 587; or
      (v) AB1 comprises the amino acid sequence of SEQ ID NO: 588; and
   b. a full length IgG antibody (AB2) that specifically binds a second target wherein the AB2 comprises two antibody heavy chains and two antibody light chains; and wherein the carboxyl terminus of each AB1 is linked to the amino terminus of each heavy chain of AB2.
5. A pharmaceutical composition comprising the bispecific antibody of claim 1 and a carrier.
6. The bispecific antibody of claim 4, wherein the bispecific antibody has one or more of the following characteristics selected from the group consisting of:

(i) the target of AB2 is selected from the group consisting of 1-92-LFA-3, Alpha-4 integrin, Alpha-V integrin, alpha4beta1 integrin, alpha4beta7 integrin, AGR2, Anti-Lewis-Y, Apelin J receptor, APRIL, B7-H4, BAFF, BTLA, C5 complement, C-242, CA9, CA19-9 (Lewis a); Carbonic anhydrase 9, CD2, CD3, CD6, CD9, CD11a, CD19, CD20, CD22, CD24, CD25, CD27, CD28, CD30, CD33, CD38, CD40, CD40L, CD41, CD44, CD44v6, CD47, CD51, CD52, CD56, CD64, CD70, CD71, CD74, CD80, CD81, CD86, CD95, CD117, CD125, CD132 (IL-2RG), CD133, CD137, CD138, CD166, CD172A, CD248, CDH6, CEACAM5 (CEA), CEACAM6 (NCA-90), CLAUDIN-3, CLAUDIN-4, cMet, Collagen, Cripto, CSFR, CSFR-1, CTLA-4, CTGF, CXCL10, CXCL13, CXCR1, CXCR2, CXCR4, CYR61, DL44, DLK1, DLL4, DPP-4, DSG1, EGFR, EGFRviii, Endothelin B receptor (ETBR), ENPP3, EpCAM, EPHA2, EPHB2, ERBB3, F protein of RSV, FAP, FGF-2, FGF8, FGFR1, FGFR2, FGFR3, FGFR4, Folate receptor, GAL3ST1, G-CSF, G-CSFR, GD2, GITR, GLUT1, GLUT4, GM-CSF, GM-CSFR, GP IIb/IIIa receptors, Gp130, GPIIB/IIIA, GPNMB, GRP78, HER2/neu, HGF, hGH, HVEM, Hyaluronidase, ICOS, IFNalpha, IFNbeta, IFNgamma, IgE, IgE Receptor (FceRI), IGF, IGF1R, IL1B, IL1R, IL2, IL11, IL12, IL12p40, IL-12R, IL-12Rbeta1, IL13, IL13R, IL15, IL17, IL18, IL21, IL23, IL23R, IL27/IL27R (wsx1), IL29, IL-31R, IL31/IL31R, IL2R, IL4, IL4R, IL6, IL6R, Insulin Receptor, Jagged Ligands, Jagged 1, Jagged 2, LAG-3, LIF-R, Lewis X, LIGHT, LRP4, LRRC26, MCSP, Mesothelin, MRP4, MUC1, Mucin-16 (MUC16 CA-125), Na/K ATPase, Neutrophil elastase, NGF, Nicastrin, Notch Receptors, Notch 1, Notch 2, Notch 3, Notch 4, NOV, OSM-R, OX-40, PAR2, PDGF-AA, PDGF-BB, PDGFRalpha, PDGFRbeta, PD-1, PD-L1, PD-L2, Phosphatidyl-serine, P1GF, PSCA, PSMA, RAAG12, RAGE, SLC44A4, Sphingosine 1 Phosphate, STEAP1, STEAP2, TAG-72, TAPA1, TGFbeta, TIGIT, TIM-3, TLR2, TLR4, TLR6, TLR7, TLR8, TLR9, TMEM31, TNFalpha, TNFR, TNFRS12A, TRAIL-R1, TRAIL-R2, Transferrin, Transferrin receptor, TRK-A, TRK-B, uPAR, VAP1, VCAM-1, VEGF, VEGF-A, VEGF-B, VEGF-C, VEGF-D, VEGFR1, VEGFR2, VEGFR3, VISTA, WISP-1, WISP-2, and WISP-3;

(ii) the bispecific antibody comprises an AB2 that is an antibody selected from the group consisting of bevacizumab, ranibizumab, cetuximab, panitumumab, infliximab, adalimumab, natalizumab, basiliximab, eculizumab, efalizumab, tositumomab, ibritumomab tiuxetan, rituximab, ofatumumab, obinutuzumab daclizumab, brentuximab vedotin, gemtuzumab, gemtuzumab ozogamicin, alemtuzumab, abiciximab, omalizumab, trastuzumab, trastuzumab emtansine, palivizumab, ipilimumab, tremelimumab, Hu5c8, pertuzumab, ertumaxomab, tanezumab, bavituximab, zalutumumab, mapatumumab, matuzumab, nimotuzumab, ICR62, mAb 528, CH806, MDX-447, edrecolomab, RAV12, huJ591, GC1008, adecatumumab, figitumumab, tocilizumab, ustekinumab, denosumab, pembrolizumab, nivolumab, and atezolizumab;

(iii) the target of AB2 is EGFR; and (iv) the bispecific antibody comprises an AB2 comprising a VH CDR1 comprising the amino acid sequence of SEQ ID NO: 94; a VH CDR2 comprising the amino acid sequence of SEQ ID NO: 95; a VH CDR3 comprising the amino acid sequence of SEQ ID NO: 96; a VL CDR1 comprising the amino acid sequence of SEQ ID NO: 97; a VL CDR2 comprising the amino acid sequence of SEQ ID NO: 98; and a VL CDR3 comprising the amino acid sequence of SEQ ID NO: 99.

7. The bispecific antibody of claim 4, wherein the MM1 has one or more of the following characteristics selected from the group consisting of:
(i) the MM1 polypeptide sequence is different from that of CD3ε;
(ii) the MM1 polypeptide sequence is no more than 50% identical to any natural binding partner of AB1;
(iii) the MM1 comprises a sequence selected from the group consisting of the sequences SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, and SEQ ID NO: 391;
(iv) the MM1 is a polypeptide of no more than 40 amino acids in length; and
(v) the MM1 comprises SEQ ID Nos: 372, 380, 383, 384, or 385.

8. The bispecific antibody of claim 4, wherein the protease that cleaves CM1 is produced by a tumor that is in proximity to cells that express CD3ε in a tissue and/or the protease that cleaves CM1 is produced by a tumor that is co-localized with the CD3ε and wherein the protease cleaves CM1 in the bispecific-antibody when the bispecific antibody is exposed to the protease.

9. The bispecific antibody of claim 4, wherein the bispecific antibody comprises a linking peptide between the MM1 and the CM1, a linking peptide between the CM1 and the AB1, or both a linking peptide between the MM1 and the CM1 and a linking peptide between the CM1 and the AB1.

10. The bispecific antibody of claim 9, wherein the linking peptides have one or more of the following characteristics selected from the group consisting of:
(i) the linking peptides need not be identical to each other; and
(ii) each of the linking peptides is a peptide of about 1 to 20 amino acids in length.

11. The bispecific antibody of claim 4, wherein the CM1 has one or more of the following characteristics selected from the group consisting of:
(i) the CM1 is a polypeptide of up to 15 amino acids in length;
(ii) the CM1 is a substrate for a protease selected from the group consisting of ADAMs or ADAMTS, aspartate proteases, aspartic cathepsins, caspases, cysteine cathepsins, cysteine proteinases, KLKs, metallo proteinases, MMPs, serine proteases and type II transmembrane serine proteases; and
(iii) the CM1 comprises an amino acid sequence selected from the group consisting of SEQ ID NO: 67-86, 321-341, and 896-926.

12. A pharmaceutical composition comprising the bispecific antibody of claim 4 and a carrier.

13. The bispecific antibody of claim 11, wherein:
(i) the ADAM or ADAMST is selected from the group consisting of ADAMS, ADAM9, ADAM10, ADAM12, ADAM15, ADAM17/TACE, ADAMDEC1, ADAMTS1, ADAMTS4 and ADAMTS5;
(ii) the aspartate protease is selected from the group consisting of BACE and renin;

(iii) the aspartic cathepsin is selected from the group consisting of cathepsin D and cathepsin E;
(iv) the caspase is selected from the group consisting of caspase 1, caspase 2, caspase 3, caspase 4, caspase 5, caspase 6, caspase 7, caspase 8, caspase 9, caspase 10 and caspase 14;
(v) the cysteine cathepsin is selected from the group consisting of cathepsin B, cathepsin C, cathepsin K, cathepsin L, cathepsin S, cathepsin V/L2 and cathepsin X/Z/P;
(vi) the cysteine proteinase is selected from the group consisting of cruzipain, legumain and otubain-2;
(vii) the KLK is selected from a group consisting of KLK4, KLK5, KLK6, KLK7, KLK8, KLK10, KLK11, KLK13 and KLK14;
(viii) the metallo proteinase is selected from the group consisting of meprin, neprilysin, PSMA and BMP-1;
(ix) the MMP is selected from the group consisting of MMP1, MMP2, MMP3, MMP7, MMP8, MMP9, MMP10, MMP11, MMP12, MMP13, MMP14, MMP15, MMP16, MMP17, MMP19, MMP20, MMP23, MMP24, MMP26 and MMP27;
(x) the serine protease is selected from the group consisting of activated protein C, cathepsin A, cathepsin G, chymase, coagulation factor proteases, elastase, granzyme B, guanidinobenzoatase, HtrA1, human neutrophil elastase, lactoferrin, marapsin, NS3/4A, PACE4, plasmin, PSA, tPA, thrombin, tryptase and uPA; and
(xi) the type II transmembrane serine protease is selected from the group consisting of DESC1, DPP-4, FAP, hepsin, matriptase-2, matriptase, TMPRSS2, TMPRSS3, and TMPRSS4.

14. The bispecific antibody of claim 13, wherein the coagulation factor protease is selected from the group consisting of FVIIa, FIXa, FXa, FXIa, and FXIIa.

15. The bispecific antibody of claim 4 comprising an agent conjugated to at least one of AB1 and AB2.

16. The bispecific antibody of claim 15, wherein the agent has one or more of the following characteristics selected from the group consisting of:
(i) the agent is a therapeutic agent, an antineoplastic agent, a toxin or fragment thereof, a detectable moiety or a diagnostic agent;
(ii) the agent is conjugated to the antibody via a linker;
(iii) the agent is conjugated to the antibody via a cleavable linker; and
(iv) the agent is conjugated to the antibody via a non-cleavable linker.

* * * * *

UNITED STATES PATENT AND TRADEMARK OFFICE
CERTIFICATE OF CORRECTION

Page 1 of 1

PATENT NO. : 10,669,337 B2
APPLICATION NO. : 14/808711
DATED : June 2, 2020
INVENTOR(S) : Bryan Allen Irving et al.

It is certified that error appears in the above-identified patent and that said Letters Patent is hereby corrected as shown below:

In the Claims

At Column 318, Claim number 13, Line number 63:
"consisting of ADAMS, ADAM9, ADAM10, ADAM12,"
Should read:
-- consisting of ADAM8, ADAM9, ADAM10, ADAM12, --

Signed and Sealed this
Fourth Day of August, 2020

Andrei Iancu
*Director of the United States Patent and Trademark Office*